United States Patent 11,446,398 (REGULATED BIOCIRCUIT SYSTEMS) - sequence listing, part 14

SEQ ID NO: 59525 - protein, 329 aa, Homo sapiens
  Payload ID: 11661
  Gene Symbol: OR10J3
  Gene Name: olfactory receptor, family 10, subfamily J, member 3
  Uniprot ID: Q5JRS4
  ENSP ID: ENSP00000331789
MPKLNSTFVTEFLFEGFSSFRRQHKLVFFVVFLTLYLLTLSGNVIIMTIIRLDHHLHTPMYFFLCMLSISETCYTVAIIPHMLSGLLNPHQPIATQSCATQLFFYLTFGINNCFLLTVMGYDRYVAICNPLRYSVIMGKRACIQLASGSLGIGLGMAIVQVTSVFGLPFCDAFVISHFFCDVRHLLKLACTDTTVNEIINFVVSVCVLVLPMGLVFISYVLIISTILKIASAEGQKKAFATCASHLTVVIIHYGCASIIYLKPKSQSSLGQDRLISVTYTHHSPTEPCCVQPEEQGGQRCSAQSRGAKNSVSLMKRGCEGFSFAFINMY

SEQ ID NO: 59526 - protein, 305 aa, Homo sapiens
  Payload ID: 11662
  Gene Symbol: OR10J4
  Gene Name: olfactory receptor, family 10, subfamily J, member 4 (gene/pseudogene)
  ENSP ID: ENSP00000475611
MPRPNFMAVTEFTFEGFSIFEWHHRLILFVIFLVLYVLTLASNAIILIVIRLNHQLHTPMYFFLSVLSISETYYTVAINPQMLSGLLSPQQTISIPGCAAQLFFYLTFGVNKCFLLTAMGYDHYVAICNPLQYSVIMGKKACIQLVSGSWNIGLSTAIIQVSSVFSLPFCDANLISHFFCDIRPIMKLACADTTIKELLLCSSVSVSLFCPWYSSSPMSLSPPSSRLHQLRAGERPLLLVPHTSQWSLSTMAVLLSSTNPNPKIPCRTDLSLHTLLLLLCTLLYTAGTKRSRMPCSELWAESLSL

SEQ ID NO: 59527 - protein, 309 aa, Homo sapiens
  Payload ID: 11663
  Gene Symbol: OR10J5
  Gene Name: olfactory receptor, family 10, subfamily J, member 5
  Uniprot ID: Q8NHC4
  ENSP ID: ENSP00000334441
MKRKNFTEVSEFIFLGFSSFGKHQITLFVVFLTVYILTLVANIIIVTIICIDHHLHTPMYFFLSMLASSETVYTLVIVPRMLLSLIFHNQPISLAGCATQMFFFVILATNNCFLLTAMGYDRYVAICRPLRYTVIMSKGLCAQLVCGSFGIGLTMAVLHVTAMFNLPFCGTVVDHFFCDIYPVMKLSCIDTTINEIINYGVSSFVIFVPIGLIFISYVLVISSILQIASAEGRKKTFATCVSHLTVVIVHCGCASIAYLKPKSESSIEKDLVLSVTYTIITPLLNPVVYSLRNKEVKDALCRVVGRNIS

SEQ ID NO: 59528 - protein, 313 aa, Homo sapiens
  Payload ID: 11664
  Gene Symbol: OR10K1
  Gene Name: olfactory receptor, family 10, subfamily K, member 1
  Uniprot ID: Q8NGX5
  ENSP ID: ENSP00000289451
MEQVNKTVVREFVVLGFSSLARLQQLLFVIFLLLYLFTLGTNAIIISTIVLDRALHTPMYFFLAILSCSEICYTFVIVPKMLVDLLSQKKTISFLGCAIQMFSFLFFGSSHSFLLAAMGYDRYMAICNPLRYSVLMGHGVCMGLMAAACACGFTVSLVTTSLVFHLPFHSSNQLHHFFCDISPVLKLASQHSGFSQLVIFMLGVFALVIPLLLILVSYIRIISAILKIPSSVGRYKTFSTCASHLIVVTVHYSCASFIYLRPKTNYTSSQDTLISVSYTILTPLFNPMIYSLRNKEFKSALRRTIGQTFYPLS

SEQ ID NO: 59529 - protein, 312 aa, Homo sapiens
  Payload ID: 11665
  Gene Symbol: OR10K2
  Gene Name: olfactory receptor, family 10, subfamily K, member 2
  Uniprot ID: Q6IF99
  ENSP ID: ENSP00000324251
MERVNETVVREVIFLGFSSLARLQQLLFVIFLLLYLFTLGTNAIIISTIVLDRALHIPMYFFLAILSCSEICYTFIIVPKMLVDLLSQKKTISFLGCAIQMFSFLFLGCSHSFLLAVMGYDRYIAICNPLRYSVLMGHGVCMGLVAAACACGFTVAQIITSLVFHLPFYSSNQLHHFFCDIAPVLKLASHHNHFSQIVIFMLCTLVLAIPLLLILVSYVHILSAILQFPSTLGRCKAFSTCVSHLIIVTVHYGCASFIYLRPQSNYSSSQDALISVSYTIITPLFNPMIYSLRNKEFKSALCKIVRRTISLL

SEQ ID NO: 59530 - protein, 313 aa, Homo sapiens
  Payload ID: 11666
  Gene Symbol: OR10P1
  Gene Name: olfactory receptor, family 10, subfamily P, member 1
  Uniprot ID: Q8NGE3
  ENSP ID: ENSP00000308082
MAGENHTTLPEFLLLGFSDLKALQGPLFWVVLLVYLVTLLGNSLIILLTQVSPALHSPMYFFLRQLSVVELFYTTDIVPRTLANLGSPHPQAISFQGCAAQMYVFIVLGISECCLLTAMAYDRYVAICQPLRYSTLLSPRACMAMVGTSWLTGIITATTHASLIFSLPFRSHPIIPHFLCDILPVLRLASAGKHRSEISVMTATIVFIMIPFSLIVTSYIRILGAILAMASTQSRRKVFSTCSSHLLVVSLFFGTASITYIRPQAGSSVTTDRVLSLFYTVITPMLNPIIYTLRNKDVRRALRHLVKRQRPSP

SEQ ID NO: 59531 - protein, 319 aa, Homo sapiens
  Payload ID: 11667
  Gene Symbol: OR10Q1
  Gene Name: olfactory receptor, family 10, subfamily Q, member 1
  Uniprot ID: Q8NGQ4
  ENSP ID: ENSP00000314324
MPVGKLVFNQSEPTEFVFRAFTTATEFQVLLFLLFLLLYLMILCGNTAIIWVVCTHSTLRTPMYFFLSNLSFLELCYTTVVVPLMLSNILGAQKPISLAGCGAQMFFFVTLGSTDCFLLAIMAYDRYVAICHPLHYTLIMTRELCTQMLGGALGLALFPSLQLTALIFTLPFCGHHQEINHFLCDVPPVLRLACADIRVHQAVLYVVSILVLTIPFLLICVSYVFITCAILSIRSAEGRRRAFSTCSFHLTVVLLQYGCCSLVYLRPRSSTSEDEDSQIALVYTFVTPLLNPLLYSLRNKDVKGALRSAIIRKAASDAN

SEQ ID NO: 59532 - protein, 335 aa, Homo sapiens
  Payload ID: 11668
  Gene Symbol: OR10R2
  Gene Name: olfactory receptor, family 10, subfamily R, member 2
  Uniprot ID: Q8NGX6
  ENSP ID: ENSP00000357134
MPQILIFTYLNMFYFFPPLQILAENLTMVTEFLLLGFSSLGEIQLALFVVFLFLYLVILSGNVTIISVIHLDKSLHTPMYFFLGILSTSETFYTFVILPKMLINLLSVARTISFNCCALQMFFFLGFAITNCLLLGVMGYDRYAAICHPLHYPTLMSWQVCGKLAAACAIGGFLASLTVVNLVFSLPFCSANKVNHYFCDISAVILLACTNTDVNEFVIFICGVLVLVVPFLFICVSYLCILRTILKIPSAEGRRKAFSTCASHLSVVIVHYGCASFIYLRPTANYVSNKDRLVTVTYTIVTPLLNPMVYSLRNKDVQLAIRKVLGKKGSLKLYN

SEQ ID NO: 59533 - protein, 331 aa, Homo sapiens
  Payload ID: 11669
  Gene Symbol: OR10S1
  Gene Name: olfactory receptor, family 10, subfamily S, member 1
  Uniprot ID: Q8NGN2
  ENSP ID: ENSP00000431914
MTSRSVCEKMTMTTENPNQTVVSHFFLEGLRYTAKHSSLFFLLFLLIYSITVAGNLLILLTVGSDSHLSLPMYHFLGHLSFLDACLSTVTVPKVMAGLLTLDGKVISFEGCAVQLYCFHFLASTECFLYTVMAYDRYLAICQPLHYPVAMNRRMCAEMAGITWAIGATHAAIHTSLTFRLLYCGPCHIAYFFCDIPPVLKLACTDTTINELVMLASIGIVAAGCLILIVISYIFIVAAVLRIRTAQGRQRAFSPCTAQLTGVLLYYVPPVCIYLQPRSSEAGAGAPAVFYTIVTPMLNPFIYTLRNKEVKHALQRLLCSSFRESTAGSPPP

SEQ ID NO: 59534 - protein, 314 aa, Homo sapiens
  Payload ID: 11670
  Gene Symbol: OR10T2
  Gene Name: olfactory receptor, family 10, subfamily T, member 2
  Uniprot ID: Q8NGX3
  ENSP ID: ENSP00000334115
MRGFNKTTVVTQFILVGFSSLGELQLLLFVIFLLLYLTILVANVTIMAVIRFSWTLHTPMYGFLFILSFSESCYTFVIIPQLLVHLLSDTKTISFMACATQLFFFLGFACTNCLLIAVMGYDRYVAICHPLRYTLIINKRLGLELISLSGATGFFIALVATNLICDMRFCGPNRVNHYFCDMAPVIKLACTDTHVKELALFSLSILVIMVPFLLILISYGFIVNTILKIPSAEGKKAFVTCASHLTVVFVHYGCASIIYLRPKSKSASDKDQLVAVTYTVVTPLLNPLVYSLRNKEVKTALKRVLGMPVATKMS

SEQ ID NO: 59535 - protein, 309 aa, Homo sapiens
  Payload ID: 11671
  Gene Symbol: OR10V1
  Gene Name: olfactory receptor, family 10, subfamily V, member 1
  Uniprot ID: Q8NGI7
  ENSP ID: ENSP00000302199
MEGINKTAKMQFFFRPFSPDPEVQMLIFVVFLMMYLTSLGGNATIAVIVQINHSLHTPMYFFLANLAVLEIFYTSSITPLALANLLSMGKTPVSITGCGTQMFFFVFLGGADCVLLVVMAYDQFIAICHPLRYRLIMSWSLCVELLVGSLVLGFLLSLPLTILIFHLPFCHNDEIYHFYCDMPAVMRLACADTRVHKTALYIISFIVLSIPLSLISISYVFIVVAILRIRSAEGRQQAYSTCSSHILVVLLQYGCTSFIYLSPSSSYSPEMGRVVSVAYTFITPILNPLIYSLRNKELKDALRKALRKF

SEQ ID NO: 59536 - protein, 305 aa, Homo sapiens
  Payload ID: 11672
  Gene Symbol: OR10W1
  Gene Name: olfactory receptor, family 10, subfamily W, member 1
  Uniprot ID: Q8NGF6
  ENSP ID: ENSP00000378516
MEFVFLAYPSCPELHILSFLGVSLVYGLIITGNILIVVSIHTETCLCTSMYYFLGSLSGIEICYTAVVVPHILANTLQSEKTITLLGCATQMAFFIALGSADCFLLAAMAYDRYVAICHPLQYPLLMTLTLCVHLVVASVISGLFLSLQLVAFIFSLPFCQAQGIEHFFCDVPPVMHVVCAQSHIHEQSVLVAAILAIAVPFFLITTSYTFIVAALLKIHSAAGRHRAFSTCSSHLTVVLLQYGCCAFMYLCPSSSYNPKQDRFISLVYTLGTPLLNPLIYALRNSEMKGAVGRVLTRNCLSQNS

SEQ ID NO: 59537 - protein, 326 aa, Homo sapiens; identical to SEQ ID NO: 59428
  Payload ID: 11673
  Gene Symbol: OR10X1
  Gene Name: olfactory receptor, family 10, subfamily X, member 1 (gene/pseudogene)
  Uniprot ID: Q8NGY0
  ENSP ID: ENSP00000357132

SEQ ID NO: 59538 - protein, 313 aa, Homo sapiens
  Payload ID: 11674
  Gene Symbol: OR10Z1
  Gene Name: olfactory receptor, family 10, subfamily Z, member 1
  Uniprot ID: Q8NGY1
  ENSP ID: ENSP00000354707
MGQTNVTSWRDFVFLGFSSSGELQLLLFALFLSLYLVTLTSNVFIIIAIRLDSHLHTPMYLFLSFLSFSETCYTLGIIPRMLSGLAGGDQAISYVGCAAQMFFSASWACTNCFLLAAMGFDRYVAICAPLHYASHMNPTLCAQLVITSFLTGYLFGLGMTLVIFHLSFCSSHEIQHFFCDTPPVLSLACGDTGPSELRIFILSLLVLLVSFFFITISYAYILAAILRIPSAEGQKKAFSTCASHLTVVIIHYGCASFVYLRPKASYSLERDQLIAMTYTVVTPLLNPIVYSLRNRAIQTALRNAFRGRLLGKG

SEQ ID NO: 59539 - protein, 315 aa, Homo sapiens
  Payload ID: 11675
  Gene Symbol: OR11A1
  Gene Name: olfactory receptor, family 11, subfamily A, member 1
  Uniprot ID: Q9GZK7
  ENSP ID: ENSP00000366352
MEIVSTGNETITEFVLLGFYDIPELHFLFFIVFTAVYVFIIIGNMLIIVAVVSSQRLHKPMYIFLANLSFLDILYTSAVMPKMLEGFLQEATISVAGCLLQFFIFGSLATAECLLLAVMAYDRYLAICYPLHYPLLMGPRRYMGLVVTTWLSGFVVDGLVVALVAQLRFCGPNHIDQFYCDFMLFVGLACSDPRVAQVTTLILSVFCLTIPFGLILTSYARIVVAVLRVPAGASRRRAFSTCSSHLAVVTTFYGTLMIFYVAPSAVHSQLLSKVFSLLYTVVTPLFNPVIYTMRNKEVHQALRKILCIKQTETLD

SEQ ID NO: 59540 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000366353

SEQ ID NO: 59541 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000366354

SEQ ID NO: 59542 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000373043

SEQ ID NO: 59543 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000373141

SEQ ID NO: 59544 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000383532

SEQ ID NO: 59545 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000383550

SEQ ID NO: 59546 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000392324

SEQ ID NO: 59547 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000398659

SEQ ID NO: 59548 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000399062

SEQ ID NO: 59549 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000399592

SEQ ID NO: 59550 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000400331

SEQ ID NO: 59551 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000400657

SEQ ID NO: 59552 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000403427

SEQ ID NO: 59553 - protein, 315 aa, Homo sapiens
  Payload ID: 11675
  Gene Symbol: OR11A1
  Gene Name: olfactory receptor, family 11, subfamily A, member 1
  Uniprot ID: Q9GZK7
  ENSP ID: ENSP00000404787
MEIVSTGNETITEFVLLGFYDIPELHFLFFIVFTAVYVFIIIGNMLIIVAVVSSQRLHKPMYIFLANLSFLDILYTSAVMPKMLEGFLQEATISVAGCLLQFFIFGSLATAECLLLAVMAYDRYLAICYPLHYPLLMGPRRYMGLVVTTWLSGFVVDGLVVALVTQLRFCGPNHIDQFYCDFMLFVGLACSDPRVAQVTTLILSVFCLTIPFGLILTSYARIVVAVLRVPAGASRRRAFSTCSSHLAVVTTFYGTLMIFYVAPSAVHSQLLSKVFSLLYTVVTPLFNPVIYTMRNKEVHQALRKILCIKQTETLD

SEQ ID NO: 59554 - protein, 315 aa, Homo sapiens; identical to SEQ ID NO: 59553
  Payload ID: 11675
  Gene Symbol: OR11A1
  Gene Name: olfactory receptor, family 11, subfamily A, member 1
  Uniprot ID: Q9GZK7
  ENSP ID: ENSP00000409994

SEQ ID NO: 59555 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000412097

SEQ ID NO: 59556 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000447215

SEQ ID NO: 59557 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000447222

SEQ ID NO: 59558 - protein, 315 aa, Homo sapiens; identical to SEQ ID NO: 59553
  Payload ID: 11675
  Gene Symbol: OR11A1
  Gene Name: olfactory receptor, family 11, subfamily A, member 1
  Uniprot ID: Q9GZK7
  ENSP ID: ENSP00000447267

SEQ ID NO: 59559 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000447627

SEQ ID NO: 59560 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000447745

SEQ ID NO: 59561 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000447956

SEQ ID NO: 59562 - protein, 315 aa, Homo sapiens; identical to SEQ ID NO: 59539
  Payload ID: 11675
  Gene Symbol: OR11A1
  Gene Name: olfactory receptor, family 11, subfamily A, member 1
  Uniprot ID: Q9GZK7
  ENSP ID: ENSP00000450263

SEQ ID NO: 59563 - protein, 345 aa, Homo sapiens
  Payload ID: 11676
  Gene Symbol: OR11G2
  Gene Name: olfactory receptor, family 11, subfamily G, member 2
  Uniprot ID: Q8NGC1
  ENSP ID: ENSP00000349930
MHFLSQNDLNINLIPHLCLHRHSVIAGAFTIHRHMKIFNSPSNSSTFTGFILLGFPCPREGQILLFVLFTVVYLLTLMGNGSIICAVHWDQRLHAPMYILLANFSFLEICYVTSTVPSMLANFLSDTKIISFSGCFLQFYFFFSLGSTECFFLAVMAFDRYLAICRPLRYPTIMTRRLCTNLVVNCWVLGFIWFLIPIVNISQMSFCGSRIIDHFLCDPAPLLTLTCKKGPVIELVFSVLSPLPVFMLFLFIVGSYALVVRAVLRVPSAAGRRKAFSTCGSHLAVVSLFYGSVLVMYGSPPSKNEAGKQKTVTLFYSVVTPLLNPVIYSLRNKDMRKALKKFWGT

SEQ ID NO: 59564 - protein, 326 aa, Homo sapiens
  Payload ID: 11677
  Gene Symbol: OR11H1
  Gene Name: olfactory receptor, family 11, subfamily H, member 1
  Uniprot ID: Q8NG94
  ENSP ID: ENSP00000252835
MCPLTLQVTGLMNVSEPNSSFAFVNEFILQGFSCEWTIQIFLFSLFTTTYALTITGNGAIAFVLWCDRRLHTPMYMFLGNFSFLEIWYVSSTVPKMLVNFLSEKKNISFAGCFLQFYFFFSLGTSECLLLTVMAFDQYLAICRPLLYPNIMTGHLYAKLVILCWVCGFLWFLIPIVLISQMPFCGPNIIDHVVCDPGPRFALDCVSAPRIQLFCYTLSSLVIFGNFLFIIGSYTLVLKAMLGMPSSTGRHKAFSTCGSHLAVVSLCYSSLMVMYVSPGLGHSTGMQKIETLFYAMVTPLFNPLIYSLQNKEIKAALRKVLGSSNII

SEQ ID NO: 59565 - protein, 326 aa, Homo sapiens
  Payload ID: 11678
  Gene Symbol: OR11H12
  Gene Name: olfactory receptor, family 11, subfamily H, member 12
  Uniprot ID: B2RN74
  ENSP ID: ENSP00000449002
MCPLTLQVTGLMNVSEPNSSFAFVNEFILQGFTCEWTIQIFLFSLFTTTYALTITGNGAIAFVLWCDWRLHTPMYMFLGNFSFLEIWYVSSTVPKMLVNFLSEKKNISFAGCFLQFYFFFSLGTSECLLLTVMAFDQYLAICRPLLYPNIMTGHLCAKLVILCWVCGFLWFLIPIVLISQMPFCGPNIIDHVVCDPGPRFALDCVSAPRIQLFCYTLSSLVIFGNFLFIIGSYTLVLKAVLGMPSSTGRHKAFSTCGSHLAVVSLCYSSLMVMYVSPGLGHSTGMQKIETLFYAMVTPLFNPLIYSLQNKEIKAALRKVLGSSNII

SEQ ID NO: 59566 - protein, 326 aa, Homo sapiens
  Payload ID: 11679
  Gene Symbol: OR11H2
  Gene Name: olfactory receptor, family 11, subfamily H, member 2
  Uniprot ID: Q8NH07
  ENSP ID: ENSP00000485150
MCPLTLHVTGLMNVSEPNSSFAFVNEFILQGFSCEWTIQIFLFSLFTTIYALTITGNGAIAFVLWCDRRLHTPMYMFLGNFSFLEIWYVSSTVPKMLVNFLSEKKNISFAGCFLQFYFFFSLGTSECLLLTVMAFDQYLAICRPLLYPNIMTGHLYAKLVILCWVCGFLWFLIPIVLISQKPFCGPNIIDHVVCDPGPLFALDCVSAPRIQLFCYTLSSLVIFGNFLFIIGSYTLVLKAVLGMPSSTGRHKAFSTCGSHLAVVSLCYSPLMVMYVSPGLGHSTGMQKIETLFYAMVTPLFNPLIYSLQNKEIKAALRKVLGSSNII

SEQ ID NO: 59567 - protein, 324 aa, Homo sapiens
  Payload ID: 11680
  Gene Symbol: OR11H4
  Gene Name: olfactory receptor, family 11, subfamily H, member 4
  Uniprot ID: Q8NGC9
  ENSP ID: ENSP00000318997
MSFFFVDLRPMNRSATHIVTEFILLGFPGCWKIQIFLFSLFLVIYVLTLLGNGAIIYAVRCNPLLHTPMYFLLGNFAFLEIWYVSSTIPNMLVNILSKTKAISFSGCFLQFYFFFSLGTTECLFLAVMAYDRYLAICHPLQYPAIMTVRFCGKLVSFCWLIGFLGYPIPIFYISQLPFCGPNIIDHFLCDMDPLMALSCAPAPITECIFYTQSSLVLFFTSMYILRSYILLLTAVFQVPSAAGRRKAFSTCGSHLVVVSLFYGTVMVMYVSPTYGIPTLLQKILTLVYSVTTPLFNPLIYTLRNKDMKLALRNVLFGMRIRQNS

SEQ ID NO: 59568 - protein, 330 aa, Homo sapiens
  Payload ID: 11681
  Gene Symbol: OR11H6
  Gene Name: olfactory receptor, family 11, subfamily H, member 6
  Uniprot ID: Q8NGC7
  ENSP ID: ENSP00000319071
MFFIIHSLVTSVFLTALGPQNRTMHFVTEFVLLGFHGQREMQSCFFSFILVLYLLTLLGNGAIVCAVKLDRRLHTPMYILLGNFAFLEIWYISSTVPNMLVNILSEIKTISFSGCFLQFYFFFSLGTTECFFLSVMAYDRYLAICRPLHYPSIMTGKFCIILVCVCWVGGFLCYPVPIVLISQLPFCGPNIIDHLVCDPGPLFALACISAPSTELICYTFNSMIIFGPFLSILGSYTLVIRAVLCIPSGAGRTKAFSTCGSHLMVVSLFYGTLMVMYVSPTSGNPAGMQKIITLVYTAMTPFLNPLIYSLRNKDMKDALKRVLGLTVSQN

SEQ ID NO: 59569 - protein, 312 aa, Homo sapiens
  Payload ID: 11682
  Gene Symbol: OR11H7
  Gene Name: olfactory receptor, family 11, subfamily H, member 7 (gene/pseudogene)
  ENSP ID: ENSP00000451021
MNNSQISTVTQFVLLGFPGPWKIQIIFFSMILLVYIFTLTGNMAIICAVRWDHRLHTPMYVLLANFSFLEIWYVTCTVPNMLVNFFSKTKTISFSGCFTQFHFFFSLGTTECFFLCVMAYDRYLAICHPLHYPSIMTGQLCGILVSLCWLIGFLGHSISIFFIFQLPFCGPNIIDHFLCDVDPLMALSSAPTHIIGHVFHSVSSLFINLTMVYILGSYTLVLRTVLVPSSAGWQKAISTCGSHLVVVSLFYGAIMLMYVSPTPGNSVAMHKLITLIYSVVTPVLNPLIYSLRNKDMKYALHHVFCGMRIIQR

SEQ ID NO: 59570 - protein, 322 aa, Homo sapiens
  Payload ID: 11683
  Gene Symbol: OR11L1
  Gene Name: olfactory receptor, family 11, subfamily L, member 1
  Uniprot ID: Q8NGX0
  ENSP ID: ENSP00000348033
MEPQNTSTVTNFQLLGFQNLLEWQALLFVIFLLIYCLTIIGNVVIITVVSQGLRLHSPMYMFLQHLSFLEVWYTSTTVPLLLANLLSWGQAISFSACMAQLYFFVFLGATECFLLAFMAYDRYLAICSPLRYPFLMHRGLCARLVVVSWCTGVSTGFLPSLMISRLDFCGRNQINHFFCDLPPLMQLSCSRVYITEVTIFILSIAVLCICFFLTLGPYVFIVSSILRIPSTSGRRKTFSTCGSHLAVVTLYYGTMISMYVCPSPHLLPEINKIISVFYTVVTPLLNPVIYSLRNKDFKEAVRKVMRRKCGILWSTSKRKFLY

SEQ ID NO: 59571 - protein, 238 aa, Homo sapiens
  Payload ID: 11684
  Gene Symbol: OR12D1
  Gene Name: olfactory receptor, family 12, subfamily D, member 1 (gene/pseudogene)
  ENSP ID: ENSP00000475351
MLNTTSVTEFLLLGVTDIQELQPFLFVVFLTIYFISVAGNGAILMIVISDPRLHSPMYFFLGNLSCLDICYSSVTLPKMLQNFLSAHKAISFLGCISQLHFFHFLGSTEAMLLAVMAFDRFVAICKPLRYTVIMNPQLCTQMAITIWMIGFFHALLHSLMTSRLNFCGSNRIYHFFCDVKPLLKLSLISGCSVLSQGQSPWAPSFSHYSPISTLSPISSSRLILLACSAKHCPLVPPT

SEQ ID NO: 59572 - protein, 307 aa, Homo sapiens
  Payload ID: 11685
  Gene Symbol: OR12D2
  Gene Name: olfactory receptor, family 12, subfamily D, member 2 (gene/pseudogene)
  Uniprot ID: P58182
  ENSP ID: ENSP00000366345
MLNTTSVTEFLLLGVTDIQELQPFLFVVFLTIYFISVTGNGAVLMIVISDPRLHSLMYFFLGNLSYLDICYSTVTLPKMLQNFLSTHKAISFLGCISQLHFFHFLGSTESMLFAVMAFDLSVAICKPLRYTVIMNPQLCTQMAITIWVIGFFHALLHSVMTSRLNFCGSNRIHHFLCDIKPLLKLACGNTELNQWLLSTVTGTIAMGPFFLTLLSYFYIITYLFFKTRSCSMLCKALSTCASHFMVVILFYAPVLFTYIHPALESFMDQDRIVAIMYTVVTPVLNPLIYTLRNKEVKGALGRVIRRL

SEQ ID NO: 59573 - protein, 307 aa, Homo sapiens
  Payload ID: 11685
  Gene Symbol: OR12D2
  Gene Name: olfactory receptor, family 12, subfamily D, member 2 (gene/pseudogene)
  Uniprot ID: P58182
  ENSP ID: ENSP00000373047
MLNTTSVTEFLLLGVTDIQELQPFLFVVFLTIYFISVTGNGAVLMIVISDPRLHSLMYFFLGNLSYLDICYSTVTLPKMLQNFLSTHKAISFLGCISQLHFFHSLGSTESMLFAVMAFDLSVAICKPLRYTVIMNPQLCTQMAITIWVIGFFHALLHSVMTSRLNFCGSNRIHHFLCDIKPLLKLACGNTELNQWLLSTVTGTIAMGPFFLTLLSYFYIITYLFFKTRSCSMLCKALSTCASHFMVVILFYAPVLFTYIHPALESFMDQDRIVAIMYTVVTPVLNPLIYTLRNKEVKGALGRVIRRL

SEQ ID NO: 59574 - protein, 307 aa, Homo sapiens
  Payload ID: 11685
  Gene Symbol: OR12D2
  Gene Name: olfactory receptor, family 12, subfamily D, member 2 (gene/pseudogene)
  ENSP ID: ENSP00000390448
MLNTTSVTEFLLLGVTDIQELQPFLFVVFLTIYFISVTGNGAVLMIFISDPRLHSPMYFFLGNLSYLDICYSTVTLPKMLQNFLSTHKAISFLGCISQLHFFHFLGSTESMLLAVMAFDRSVAICKPLRYTVIMNPQLCTQMAITIWVIGFFHALLHSIMTSRLNFCGSNRIHHFLCDIKPLLKLACGNTELNQWLLSTVTGTIAMGPFFLTLLSYFYIITYLFFKTRSCSMLCKALSTCASHFMVVILFYAPVLFTYIHPALESFMDQDRIVAIMYTVVTPVLNPLIYTLRNKEVKGALGRVIRRL

SEQ ID NO: 59575 - protein, 307 aa, Homo sapiens
  Payload ID: 11685
  Gene Symbol: OR12D2
  Gene Name: olfactory receptor, family 12, subfamily D, member 2 (gene/pseudogene)
  ENSP ID: ENSP00000400571
MLNTTSVTEFLLLGVTDIQELQPFLFVVFLTIYFISVTGNGAVLMIFISDPRLHSPMYFFLGNLSYLDICYSTVTLPKMLQNFLSTHKAISFLGCISQLHFFHFLGSTESMLLAVMAFDRCVAICKPLRYTVIMNPQLCTQMAITIWVIGFFHALLHSIMTSRLNFCGSNRIHHFLCDIKPLLKLACGNTELNQWLLSTVTGTIAMGPFFLTLLSYFYIITYLFFKTRSCSMLCKALSTCASHFMVVILFYAPVLFTYIHPALESFMDQDRIVAIMYTVVTPVLNPLIYTLRNKEVKGALGRVIRRL

SEQ ID NO: 59576 - protein, 307 aa, Homo sapiens; identical to SEQ ID NO: 59572
  Payload ID: 11685
  Gene Symbol: OR12D2
  Gene Name: olfactory receptor, family 12, subfamily D, member 2 (gene/pseudogene)
  Uniprot ID: P58182
  ENSP ID: ENSP00000414137

SEQ ID NO: 59577 - protein, 307 aa, Homo sapiens; identical to SEQ ID NO: 59572
  Payload ID: 11685
  Gene Symbol: OR12D2
  Gene Name: olfactory receptor, family 12, subfamily D, member 2 (gene/pseudogene)
  Uniprot ID: P58182
  ENSP ID: ENSP00000415065

SEQ ID NO: 59578 - protein, 307 aa, Homo sapiens; identical to SEQ ID NO: 59573
  Payload ID: 11685
  Gene Symbol: OR12D2
  Gene Name: olfactory receptor, family 12, subfamily D, member 2 (gene/pseudogene)
  Uniprot ID: P58182
  ENSP ID: ENSP00000485068

SEQ ID NO: 59579 - protein, 307 aa, Homo sapiens; identical to SEQ ID NO: 59573
  Payload ID: 11685
  Gene Symbol: OR12D2
  Gene Name: olfactory receptor, family 12, subfamily D, member 2 (gene/pseudogene)
  Uniprot ID: P58182
  ENSP ID: ENSP00000485112

SEQ ID NO: 59580 - protein, 316 aa, Homo sapiens
  Payload ID: 11686
  Gene Symbol: OR12D3
  Gene Name: olfactory receptor, family 12, subfamily D, member 3
  Uniprot ID: Q9UGF7
  ENSP ID: ENSP00000373048
MENVTTMNEFLLLGLTGVQELQPFFFGIFLIIYLINLIGNGSILVMVVLEPQLHSPMYFFLGNLSCLDISYSSVTLPKLLVNLVCSRRAISFLGCITQLHFFHFLGSTEAILLAIMAFDRFVAICNPLRYTVIMNPQVCILLAAAAWLISFFYALMHSVMTAHLSFCGSQKLNHFFYDVKPLLELACSDTLLNQWLLSIVTGSISMGAFFLTLLSCFYVIGFLLFKNRSCRILHKALSTCASHFMVVCLFYGPVGFTYIRPASATSMIQDRIMAIMYSAVTPVLNPLIYTLRNKEVMMALKKIFGRKLFKDWQQHH

SEQ ID NO: 59581 - protein, 316 aa, Homo sapiens; identical to SEQ ID NO: 59580
  Payload ID: 11686
  Gene Symbol: OR12D3
  Gene Name: olfactory receptor, family 12, subfamily D, member 3
  Uniprot ID: Q9UGF7
  ENSP ID: ENSP00000380023

SEQ ID NO: 59582 - protein, 316 aa, Homo sapiens; identical to SEQ ID NO: 59580
  Payload ID: 11686
  Gene Symbol: OR12D3
  Gene Name: olfactory receptor, family 12, subfamily D, member 3
  Uniprot ID: Q9UGF7
  ENSP ID: ENSP00000393734

SEQ ID NO: 59583 - protein, 316 aa, Homo sapiens; identical to SEQ ID NO: 59580
  Payload ID: 11686
  Gene Symbol: OR12D3
  Gene Name: olfactory receptor, family 12, subfamily D, member 3
  Uniprot ID: Q9UGF7
  ENSP ID: ENSP00000421215

SEQ ID NO: 59584 - protein, 316 aa, Homo sapiens
  Payload ID: 11686
  Gene Symbol: OR12D3
  Gene Name: olfactory receptor, family 12, subfamily D, member 3
  ENSP ID: ENSP00000421346
MENVTTMNEFLLLGLTGVQELQPFFFGIFLIIYLINLIGNGSILVMVVLEPQLHSPMYFFLGNLSCLDISYSSVTLPKLLVNLVCSRRAISFLGCIIQLHFFHFLGSTEAILLAIMAFDRFVAICNPLRYTVIMNPQVCILLAAAAWLISFFYALMHSVMTAHLSFCGSQKLNHFFYDVKPLLELACSDTLLNQWLLSIVTGSISMGAFFLTLLSCFYVIGFLLFKNRSCRILHKALSTCASHFMVVCLFYGPVGFTYIRPASATSMIQDRIMAIMYSAVTPVLNPLIYTLRNKEVMMALKKIFGRKLFKDWQQHH

SEQ ID NO: 59585 - protein, 316 aa, Homo sapiens; identical to SEQ ID NO: 59584
  Payload ID: 11686
  Gene Symbol: OR12D3
  Gene Name: olfactory receptor, family 12, subfamily D, member 3
  ENSP ID: ENSP00000424840

SEQ ID NO: 59586 - protein, 316 aa, Homo sapiens; identical to SEQ ID NO: 59584
  Payload ID: 11686
  Gene Symbol: OR12D3
  Gene Name: olfactory receptor, family 12, subfamily D, member 3
  ENSP ID: ENSP00000447118

SEQ ID NO: 59587 - protein, 316 aa, Homo sapiens; identical to SEQ ID NO: 59580
  Payload ID: 11686
  Gene Symbol: OR12D3
  Gene Name: olfactory receptor, family 12, subfamily D, member 3
  Uniprot ID: Q9UGF7
  ENSP ID: ENSP00000447204

SEQ ID NO: 59588 - protein, 316 aa, Homo sapiens; identical to SEQ ID NO: 59580
  Payload ID: 11686
  Gene Symbol: OR12D3
  Gene Name: olfactory receptor, family 12, subfamily D, member 3
  Uniprot ID: Q9UGF7
  ENSP ID: ENSP00000447580

SEQ ID NO: 59589 - protein, 316 aa, Homo sapiens; identical to SEQ ID NO: 59584
  Payload ID: 11686
  Gene Symbol: OR12D3
  Gene Name: olfactory receptor, family 12, subfamily D, member 3
  ENSP ID: ENSP00000448923

SEQ ID NO: 59590 - protein, 316 aa, Homo sapiens; identical to SEQ ID NO: 59580
  Payload ID: 11686
  Gene Symbol: OR12D3
  Gene Name: olfactory receptor, family 12, subfamily D, member 3
  Uniprot ID: Q9UGF7
  ENSP ID: ENSP00000449350

SEQ ID NO: 59591 - protein, 328 aa, Homo sapiens
  Payload ID: 11687
  Gene Symbol: OR13A1
  Gene Name: olfactory receptor, family 13, subfamily A, member 1
  Uniprot ID: Q8NGR1
  ENSP ID: ENSP00000363522
MKLWMESHLIVPETRPSPRMMSNQTLVTEFILQGFSEHPEYRVFLFSCFLFLYSGALTGNVLITLAITFNPGLHAPMYFFLLNLATMDIICTSSIMPKALASLVSEESSISYGGCMAQLYFLTWAASSELLLLTVMAYDRYAAICHPLHYSSMMSKVFCSGLATAVWLLCAVNTAIHTGLMLRLDFCGPNVIIHFFCEVPPLLLLSCSSTYVNGVMIVLADAFYGIVNFLMTIASYGFIVSSILKVKTAWGRQKAFSTCSSHLTVVCMYYTAVFYAYISPVSGYSAGKSKLAGLLYTVLSPTLNPLIYTLRNKEVKAALRKLFPFFRN

SEQ ID NO: 59592 - protein, 328 aa, Homo sapiens; identical to SEQ ID NO: 59591
  Payload ID: 11687
  Gene Symbol: OR13A1
  Gene Name: olfactory receptor, family 13, subfamily A, member 1
  Uniprot ID: Q8NGR1
  ENSP ID: ENSP00000438657

SEQ ID NO: 59593 - protein, 328 aa, Homo sapiens; identical to SEQ ID NO: 59591
  Payload ID: 11687
  Gene Symbol: OR13A1
  Gene Name: olfactory receptor, family 13, subfamily A, member 1
  Uniprot ID: Q8NGR1
  ENSP ID: ENSP00000451950

SEQ ID NO: 59594 - protein, 328 aa, Homo sapiens; identical to SEQ ID NO: 59591
  Payload ID: 11687
  Gene Symbol: OR13A1
  Gene Name: olfactory receptor, family 13, subfamily A, member 1
  Uniprot ID: Q8NGR1
  ENSP ID: ENSP00000480319

SEQ ID NO: 59595 - protein, 328 aa, Homo sapiens; identical to SEQ ID NO: 59591
  Payload ID: 11687
  Gene Symbol: OR13A1
  Gene Name: olfactory receptor, family 13, subfamily A, member 1
  Uniprot ID: Q8NGR1
  ENSP ID: ENSP00000483252

SEQ ID NO: 59596 - protein, 328 aa, Homo sapiens; identical to SEQ ID NO: 59591
  Payload ID: 11687
  Gene Symbol: OR13A1
  Gene Name: olfactory receptor, family 13, subfamily A, member 1
  Uniprot ID: Q8NGR1
  ENSP ID: ENSP00000484353

SEQ ID NO: 59597 - protein, 318 aa, Homo sapiens
  Payload ID: 11688
  Gene Symbol: OR13C2
  Gene Name: olfactory receptor, family 13, subfamily C, member 2
  Uniprot ID: Q8NGS9
  ENSP ID: ENSP00000438815
MEWENHTILVEFFLKGLSGHPRLELLFFVLIFIMYVVILLGNGTLILISILDPHLHTPMYFFLGNLSFLDICYTTTSIPSTLVSFLSERKTISLSGCAVQMFLGLAMGTTECVLLGMMAFDRYVAICNPLRYPIIMSKDAYVPMAAGSWIIGAVNSAVQSVFVVQLPFCRNNIINHFTCEILAVMKLACADISDNEFIMLVATTLFILTPLLLIIVSYTLIIVSIFKISSSEGRSKASSTCSAHLTVVIIFYGTILFMYMKPKSKETLNSDDLDATDKIISMFYGVMTPMMNPLIYSLRNKDVKEAVKHLLNRRFFSK

SEQ ID NO: 59598 - protein, 347 aa, Homo sapiens
  Payload ID: 11689
  Gene Symbol: OR13C3
  Gene Name: olfactory receptor, family 13, subfamily C, member 3
  Uniprot ID: Q8NGS6
  ENSP ID: ENSP00000363913
MIVQLICTVCFLAVNTFHVRSSFDFLKADDMGEINQTLVSEFLLLGLSGYPKIEIVYFALILVMYLVILIGNGVLIIASIFDSHFHTPMYFFLGNLSFLDICYTSSSVPSTLVSLISKKRNISFSGCAVQMFFGFAMGSTECLLLGMMAFDRYVAICNPLRYPIILSKVAYVLMASVSWLSGGINSAVQTLLAMRLPFCGNNIINHFACEILAVLKLACADISLNIITMVISNMAFLVLPLMVIFFSYMFILYTILQMNSATGRRKAFSTCSAHLTVVIIFYGTIFFMYAKPKSQDLIGEEKLQALDKLISLFYGVVTPMLNPILYSLRNKDVKAAVKYLLNKKPIH

SEQ ID NO: 59599 - protein, 318 aa, Homo sapiens
  Payload ID: 11690
  Gene Symbol: OR13C4
  Gene Name: olfactory receptor, family 13, subfamily C, member 4
  Uniprot ID: Q8NGS5
  ENSP ID: ENSP00000277216
MDKINQTFVREFILLGLSGYPKLEIIFFALILVMYVVILIGNGVLIIASILDSRLHMPMYFFLGNLSFLDICYTTSSIPSTLVSLISKKRNISFSGCAVQMFFGFAMGSTECFLLGMMAFDRYVAICNPLRYPIIMNKVVYVLLTSVSWLSGGINSTVQTSLAMRWPFCGNNIINHFLCEILAVLKLACSDISVNIVTLAVSNIAFLVLPLLVIFFSYMFILYTILRTNSATGRHKAFSTCSAHLTVVIIFYGTIFFMYAKPKSQDLLGKDNLQATEGLVSMFYGVVTPMLNPIIYSLRNKDVKAAIKYLLSRKAINQ

SEQ ID NO: 59600 - protein, 318 aa, Homo sapiens
  Payload ID: 11691
  Gene Symbol: OR13C5
  Gene Name: olfactory receptor, family 13, subfamily C, member 5
  Uniprot ID: Q8NGS8
  ENSP ID: ENSP00000363911
MEWENHTILVEFFLKGLSGHPRLELLFFVLIFIMYVVILLGNGTLILISILDPHLHTPMYFFLGNLSFLDICYTTTSIPSTLVSFLSERKTISLSGCAVQMFLSLAMGTTECVLLGVMAFDRYVAICNPLRYPIIMSKDAYVPMAAGSWIIGAVNSAVQTVFVVQLPFCRNNIINHFTCEILAVMKLACADISGNEFILLVTTTLFLLTPLLLIIVSYTLIILSIFKISSSEGRSKPSSTCSARLTVVITFCGTIFLMYMKPKSQETLNSDDLDATDKLIFIFYRVMTPMMNPLIYSLRNKDVKEAVKHLLRRKNFNK

SEQ ID NO: 59601 - protein, 307 aa, Homo sapiens
  Payload ID: 11692
  Gene Symbol: OR13C7
  Gene Name: olfactory receptor, family 13, subfamily C, member 7 (gene/pseudogene)
  ENSP ID: ENSP00000477333
MVSANQTASVTEFILLGLSAHPKLEKTFFVLILLMYLVILLGNGVLILMTVSNSHLHMPMYFFLGNLSFLDICYTTSSVPLILDSFLTPRKTISFSACAVQMFLSFAMGATECVLLSMMAFDRYVAICNPLRYPVVMSKAAYMPIRLPAPGLEALLPWCRHPLQGCPSVETTSSTTSPVRFWLSSWPVLISLSMSVWEPMSSWGSRFCSSLSPMSSSLPPSGSPQLRGGKRPSPPALPTSQSWSSSMGPSSSCMGSPSLRTRWGQTSKTLQTNSFPFSMGWPPCSTPSSTAGTRMRLLGTYFRNALP

SEQ ID NO: 59602 - protein, 320 aa, Homo sapiens
  Payload ID: 11693
  Gene Symbol: OR13C8
  Gene Name: olfactory receptor, family 13, subfamily C, member 8
  Uniprot ID: Q8NGS7
  ENSP ID: ENSP00000334068
MERTNDSTSTEFFLVGLSAHPKLQTVFFVLILWMYLMILLGNGVLISVIIFDSHLHTPMYFFLCNLSFLDVCYTSSSVPLILASFLAVKKKVSFSGCMVQMFISFAMGATECMILGTMALDRYVAICYPLRYPVIMSKGAYVAMAAGSWVTGLVDSVVQTAFAMQLPFCANNVIKHFVCEILAILKLACADISINVISMTGSNLIVLVIPLLVISISYIFIVATILRIPSTEGKHKAFSTCSAHLTVVIIFYGTIFFMYAKPESKASVDSGNEDIIEALISLFYGVMTPMLNPLIYSLRNKDVKAAVKNILCRKNFSDGK

SEQ ID NO: 59603 - protein, 318 aa, Homo sapiens
  Payload ID: 11694
  Gene Symbol: OR13C9
  Gene Name: olfactory receptor, family 13, subfamily C, member 9
  Uniprot ID: Q8NGT0
  ENSP ID: ENSP00000259362
MEWENQTILVEFFLKGHSVHPRLELLFFVLIFIMYVVILLGNGTLILISILDPHLHTPMYFFLGNLSFLDICYTTTSIPSTLVSFLSERKTISFSGCAVQMFLGLAMGTTECVLLGMMAFDRYVAICNPLRYPIIMSKNAYVPMAVGSWFAGIVNSAVQTTFVVQLPFCRKNVINHFSCEILAVMKLACADISGNEFLMLVATILFTLMPLLLIVISYSLIISSILKIHSSEGRSKAFSTCSAHLTVVIIFYGTILFMYMKPKSKETLNSDDLDATDKIISMFYGVMTPMMNPLIYSLRNKDVKEAVKHLPNRRFFSK

SEQ ID NO: 59604 - protein, 346 aa, Homo sapiens
  Payload ID: 11695
  Gene Symbol: OR13D1
  Gene Name: olfactory receptor, family 13, subfamily D, member 1
  Uniprot ID: Q8NGV5
  ENSP ID: ENSP00000317357
MYRFTDFDVSNISIYLNHVLFYTTQQAGDLEHMETRNYSAMTEFFLVGLSQYPELQLFLFLLCLIMYMIILLGNSLLIIITILDSRLHTPMYFFLGNLSFLDICYTSSSIPPMLIIFMSERKSISFIGCALQMVVSLGLGSTECVLLAVMAYDHYVAICNPLRYSIIMNGVLYVQMAAWSWIIGCLTSLLQTVLTMMLPFCGNNVIDHITCEILALLKLVCSDITINVLIMTVTNIVSLVILLLLIFISYVFILSSILRINCAEGRKKAFSTCSAHSIVVILFYGSALFMYMKPKSKNTNTSDEIIGLSYGVVSPMLNPIIYSLRNKEVKEAVKKVLSRHLHLLKM

SEQ ID NO: 59605 - protein, 319 aa, Homo sapiens
  Payload ID: 11696
  Gene Symbol: OR13F1
  Gene Name: olfactory receptor, family 13, subfamily F, member 1
  Uniprot ID: Q8NGS4
  ENSP ID: ENSP00000334452
MFPANWTSVKVFFFLGFFHYPKVQVIIFAVCLLMYLITLLGNIFLISITILDSHLHTPMYLFLSNLSFLDIWYSSSALSPMLANFVSGRNTISFSGCATQMYLSLAMGSTECVLLPMMAYDRYVAICNPLRYPVIMNRRTCVQIAAGSWMTGCLTAMVEMMSVLPLSLCGNSIINHFTCEILAILKLVCVDTSLVQLIMLVISVLLLPMPMLLICISYAFILASILRISSVEGRSKAFSTCTAHLMVVVLFYGTALSMHLKPSAVDSQEIDKFMALVYAGQTPMLNPIIYSLRNKEVKVALKKLLIRNHFNTAFISILK

SEQ ID NO: 59606 - protein, 307 aa, Homo sapiens
  Payload ID: 11697
  Gene Symbol: OR13G1
  Gene Name: olfactory receptor, family 13, subfamily G, member 1
  Uniprot ID: Q8NGZ3
  ENSP ID: ENSP00000352717
MNHSVVTEFIILGLTKKPELQGIIFLFFLIVYLVAFLGNMLIIIAKIYNNTLHTPMYVFLLTLAVVDIICTTSIIPKMLGTMLTSENTISYAGCMSQLFLFTWSLGAEMVLFTTMAYDRYVAICFPLHYSTIMNHHMCVALLSMVMAIAVTNSWVHTALIMRLTFCGPNTIDHFFCEIPPLLALSCSPVRINEVMVYVADITLAIGDFILTCISYGFIIVAILRIRTVEGKRKAFSTCSSHLTVVTLYYSPVIYTYIRPASSYTFERDKVVAALYTLVTPTLNPMVYSFQNREMQAGIRKVFAFLKH

SEQ ID NO: 59607 - protein, 308 aa, Homo sapiens
  Payload ID: 11698
  Gene Symbol: OR13H1
  Gene Name: olfactory receptor, family 13, subfamily H, member 1
  Uniprot ID: Q8NG92
  ENSP ID: ENSP00000340748
MAMDNVTAVFQFLLIGISNYPQWRDTFFTLVLIIYLSTLLGNGFMIFLIHFDPNLHTPIYFFLSNLSFLDLCYGTASMPQALVHCFSTHPYLSYPRCLAQTSVSLALATAECLLLAAMAYDRVVAISNPLRYSVVMNGPVCVCLVATSWGTSLVLTAMLILSLRLHFCGANVINHFACEILSLIKLTCSDTSLNEFMILITSIFTLLLPFGFVLLSYIRIAMAIIRIRSLQGRLKAFTTCGSHLTVVTIFYGSAISMYMKTQSKSYPDQDKFISVFYGALTPMLNPLIYSLRKKDVKRAIRKVMLKRT

SEQ ID NO: 59608 - protein, 312 aa, Homo sapiens
  Payload ID: 11699
  Gene Symbol: OR13J1
  Gene Name: olfactory receptor, family 13, subfamily J, member 1
  Uniprot ID: Q8NGT2
  ENSP ID: ENSP00000367219
MEPLNRTEVSEFFLKGFSGYPALEHLLFPLCSAMYLVTLLGNTAIMAVSVLDIHLHTPVYFFLGNLSTLDICYTPTFVPLMLVHLLSSRKTISFAVCAIQMCLSLSTGSTECLLLAITAYDRYLAICQPLRYHVLMSHRLCVLLMGAAWVLCLLKSVTEMVISMRLPFCGHHVVSHFTCKILAVLKLACGNTSVSEDFLLAGSILLLPVPLAFICLSYLLILATILRVPSAARCCKAFSTCLAHLAVVLLFYGTIIFMYLKPKSKEAHISDEVFTVLYAMVTTMLNPTIYSLRNKEVKEAARKVWGRSRASR

SEQ ID NO: 59609 - protein, 309 aa, Homo sapiens
  Payload ID: 11700
  Gene Symbol: OR14A16
  Gene Name: olfactory receptor, family 14, subfamily A, member 16
  Uniprot ID: Q8NHC5
  ENSP ID: ENSP00000350248
MANLTIVTEFILMGFSTNKNMCILHSILFLLIYLCALMGNVLIIMITTLDHHLHTPVYFFLKNLSFLDLCLISVTAPKSIANSLIHNNSISFLGCVSQVFLLLSSASAELLLLTVMSFDRYTAICHPLHYDVIMDRSTCVQRATVSWLYGGLIAVMHTAGTFSLSYCGSNMVHQFFCDIPQLLAISCSENLIREIALILINVVLDFCCFIVIIITYVHVFSTVKKIPSTEGQSKAYSICLPHLLVVLFLSTGFIAYLKPASESPSILDAVISVFYTMLPPTFNPIIYSLRNKAIKVALGMLIKGKLTKK

SEQ ID NO: 59610 - protein, 314 aa, Homo sapiens
  Payload ID: 11701
  Gene Symbol: OR14A2
  Gene Name: olfactory receptor, family 14, subfamily A, member 2
  Uniprot ID: Q96R54
  ENSP ID: ENSP00000355441
MANVTLVTGFLLMGFSNIQKLRILYGVLFLLIYLAALMSNLLIITLITLDVKLQTPMYFFLKNLSFLDVFLVSVPIPKFIVNNLTHNNSISILGCAFQLLLMTSFSAGEIFILTAMSYDRYVAICCPLNYEVIMNTGVCVLMASVSWAIGGLFGTAYTAGTFSMPFCGSSVIPQFFCDVPSLLRISCSETLMVIYAGIGVGACLSISCFICIVISYIYIFSTVLKIPTTKGQSKAFSTCFPHLTVFTVFIITAYFVYLKPPSNSPSVIDRLLSVIYTVMPPVFNPVTYSLRNNDMKCALIRLLQKTYGQEAYFI

SEQ ID NO: 59611 - protein, 312 aa, Homo sapiens
  Payload ID: 11702
  Gene Symbol: OR14C36
  Gene Name: olfactory receptor, family 14, subfamily C, member 36
  Uniprot ID: Q8NHC7
  ENSP ID: ENSP00000324534
MPNSTTVMEFLLMRFSDVWTLQILHSASFFMLYLVTLMGNILIVTVTTCDSSLHMPMYFFLRNLSILDACYISVTVPTSCVNSLLDSTTISKAGCVAQVFLVVFFVYVELLFLTIMAHDRYVAVCQPLHYPVIVNSRICIQMTLASLLSGLVYAGMHTGSTFQLPFCRSNVIHQFFCDIPSLLKLSCSDTFSNEVMIVVSALGVGGGCFIFIIRSYIHIFSTVLGFPRGADRTKAFSTCIPHILVVSVFLSSCSSVYLRPPAIPAATQDLILSGFYSIMPPLFNPIIYSLRNKQIKVAIKKIMKRIFYSENV

SEQ ID NO: 59612 - protein, 311 aa, Homo sapiens
  Payload ID: 11703
  Gene Symbol: OR14I1
  Gene Name: olfactory receptor, family 14, subfamily I, member 1
  Uniprot ID: A6ND48
  ENSP ID: ENSP00000339726
MDNLTKVTEFLLMEFSGIWELQVLHAGLFLLIYLAVLVGNLLIIAVITLDQHLHTPMYFFLKNLSVLDLCYISVTVPKSIRNSLTRRSSISYLGCVAQVYFFSAFASAELAFLTVMSYDRYVAICHPLQYRAVMTSGGCYQMAVTTWLSCFSYAAVHTGNMFREHVCRSSVIHQFFRDIPHVLALVSCEVFFVEFLTLALSSCLVLGCFILMMISYFQIFSTVLRIPSGQSRAKAFSTCSPQLIVIMLFLTTGLFAALGPIAKALSIQDLVIALTYTVLPPFLNPIIYSLRNKEIKTAMWRLFVKIYFLQK

SEQ ID NO: 59613 - protein, 321 aa, Homo sapiens
  Payload ID: 11704
  Gene Symbol: OR14J1
  Gene Name: olfactory receptor, family 14, subfamily J, member 1
  Uniprot ID: Q9UGF5
  ENSP ID: ENSP00000230221
MVNLTSMSGFLLMGFSDERKLQILHALVFLVTYLLALTGNLLIITIITVDRRLHSPMYYFLKHLSLLDLCFISVTVPQSIANSLMGNGYISLVQCILQVFFFIALASSEVAILTVMSYDRYAAICQPLHYETIMDPRACRHAVIAVWIAGGLSGLMHAAINFSIPLCGKRVIHQFFCDVPQMLKLACSYEFINEIALAAFTTSAAFICLISIVLSYIRIFSTVLRIPSAEGRTKVFSTCLPHLFVATFFLSAAGFEFLRLPSDSSSTVDLVFSVFYTVIPPTLNPVIYSLRNDSMKAALRKMLSKEELPQRKMCLKAMFKL

SEQ ID NO: 59614 - protein, 321 aa, Homo sapiens; identical to SEQ ID NO: 59613
  Payload ID: 11704
  Gene Symbol: OR14J1
  Gene Name: olfactory receptor, family 14, subfamily J, member 1
  Uniprot ID: Q9UGF5
  ENSP ID: ENSP00000366365

SEQ ID NO: 59615 - protein, 321 aa, Homo sapiens
  Payload ID: 11704
  Gene Symbol: OR14J1
  Gene Name: olfactory receptor, family 14, subfamily J, member 1
  Uniprot ID: Q9UGF5
  ENSP ID: ENSP00000389802
MVNLTSTSGFLLMGFSDERKLQILHALVFLVTYLLALTGNLLIITIITVDRRLHSPMYYFLKHLSLLDLCFISVTVPQSIANSLMGNGYISLVQCILQVFFFIALASSEVAILTVMSYDRYAAICQPLHYETIMDPRACRHAVIAVWIAGGLSGLMHAAINFSIPLCGKRVIHQFFCDVPQMLKLACSYEFINEIALAAFTTSAAFICLISIVLSYIRIFSTVLRIPSAEGRTKVFSTCLPHLFVATFFLSAAGFEFLRLPSDSSSTVDLVFSVFYTVIPPTLNPVIYSLRNDSMKAALRKMLSKEELPQRKMCLKAMFKL

SEQ ID NO: 59616 - protein, 321 aa, Homo sapiens; identical to SEQ ID NO: 59613
  Payload ID: 11704
  Gene Symbol: OR14J1
  Gene Name: olfactory receptor, family 14, subfamily J, member 1
  Uniprot ID: Q9UGF5
  ENSP ID: ENSP00000398851

SEQ ID NO: 59617 - protein, 321 aa, Homo sapiens; identical to SEQ ID NO: 59615
  Payload ID: 11704
  Gene Symbol: OR14J1
  Gene Name: olfactory receptor, family 14, subfamily J, member 1
  Uniprot ID: Q9UGF5
  ENSP ID: ENSP00000400501

SEQ ID NO: 59618 - protein, 321 aa, Homo sapiens; identical to SEQ ID NO: 59615
  Payload ID: 11704
  Gene Symbol: OR14J1
  Gene Name: olfactory receptor, family 14, subfamily J, member 1
  Uniprot ID: Q9UGF5
  ENSP ID: ENSP00000403553

SEQ ID NO: 59619 - protein, 321 aa, Homo sapiens; identical to SEQ ID NO: 59615
  Payload ID: 11704
  Gene Symbol: OR14J1
  Gene Name: olfactory receptor, family 14, subfamily J, member 1
  Uniprot ID: Q9UGF5
  ENSP ID: ENSP00000408647

SEQ ID NO: 59620 - protein, 314 aa, Homo sapiens
  Payload ID: 11705
  Gene Symbol: OR14K1
  Gene Name: olfactory receptor, family 14, subfamily K, member 1
  Uniprot ID: Q8NGZ2
  ENSP ID: ENSP00000283225
MTNQTQMMEFLLVRFTENWVLLRLHALLFSLIYLTAVLMNLVIILLMILDHRLHMAMYFFLRHLSFLDLCLISATVPKSILNSVASTDSISFLGCVLQLFLVVLLAGSEIGILTAMSYDRYAAICCPLHCEAVMSRGLCVQLMALSWLNRGALGLLYTAGTFSLNFYGSDELHQFFCDVPALLKLTCSKEHAIISVSVAIGVCYAFSCLVCIVVSYVYIFSAVLRISQRQRQSKAFSNCVPHLIVVTVFLVTGAVAYLKPGSDAPSILDLLVSVFYSVAPPTLNPVIYCLKNKDIKSALSKVLWNVRSSGVMKR

SEQ ID NO: 59621 - protein, 310 aa, Homo sapiens
  Payload ID: 11706
  Gene Symbol: OR2A1
  Gene Name: olfactory receptor, family 2, subfamily A, member 1
  Uniprot ID: Q8NGT9
  ENSP ID: ENSP00000386175
MGENQTMVTEFLLLGFLLGPRIQMLLFGLFSLFYIFTLLGNGAILGLISLDSRLHTPMYFFLSHLAVVDIAYTRNTVPQMLANLLHPAKPISFAGCMTQTFLCLSFGHSECLLLVLMSYDRYVAICHPLRYSVIMTWRVCITLAVTSWTCGSLLALAHVVLILRLPFSGPHEINHFFCEILSVLRLACADTWLNQVVIFAACVFFLVGPPSLVLVSYSHILAAILRIQSGEGRRKAFSTCSSHLCVVGLFFGSAIIMYMAPKSRHPEEQQKVFFLFYSFFNPTLNPLIYSLRNGEVKGALRRALGKESHS

SEQ ID NO: 59622 - protein, 310 aa, Homo sapiens
  Payload ID: 11707
  Gene Symbol: OR2A12
  Gene Name: olfactory receptor, family 2, subfamily A, member 12
  Uniprot ID: Q8NGT7
  ENSP ID: ENSP00000386174
MESNQTWITEVILLGFQVDPALELFLFGFFLLFYSLTLMGNGIILGLIYLDSRLHTPMYVFLSHLAIVDMSYASSTVPKMLANLVMHKKVISFAPCILQTFLYLAFAITECLILVMMCYDRYVAICHPLQYTLIMNWRVCTVLASTCWIFSFLLALVHITLILRLPFCGPQKINHFFCQIMSVFKLACADTRLNQVVLFAGSAFILVGPLCLVLVSYLHILVAILRIQSGEGRRKAFSTCSSHLCVVGLFFGSAIVMYMAPKSSHSQERRKILSLFYSLFNPILNPLIYSLRNAEVKGALKRVLWKQRSM

SEQ ID NO: 59623 - protein, 310 aa, Homo sapiens
  Payload ID: 11708
  Gene Symbol: OR2A14
  Gene Name: olfactory receptor, family 2, subfamily A, member 14
  Uniprot ID: Q96R47
  ENSP ID: ENSP00000386137
MEGNKTWITDITLPRFQVGPALEILLCGLFSAFYTLTLLGNGVIFGIICLDCKLHTPMYFFLSHLAIVDISYASNYVPKMLTNLMNQESTISFFPCIMQTFLYLAFAHVECLILVVMSYDRYADICHPLRYNSLMSWRVCTVLAVASWVFSFLLALVPLVLILSLPFCGPHEINHFFCEILSVLKLACADTWLNQVVIFAACVFILVGPLCLVLVSYLRILAAILRIQSGEGRRKAFSTCSSHLCVVGLFFGSAIVTYMAPKSRHPEEQQKVLSLFYSLFNPMLNPLIYSLRNAEVKGALRRALRKERLT

SEQ ID NO: 59624 - protein, 308 aa, Homo sapiens
  Payload ID: 11708
  Gene Symbol: OR2A14
  Gene Name: olfactory receptor, family 2, subfamily A, member 14
  ENSP ID: ENSP00000486470
MEGNQTWITDITLLGFQVGPALAILLCGLFSVFYTLTLLGNGVIFGIICLDSKLHTPMYFFLSHLAIIDMSYASNNVPKMLANLMNQKRTISFVPCIMQTFLYLAFAVTECLILVVMSYDRYVAICHPFQYTVIMSWRVCTVLAVASWVFSFLLALVPLVLILSLPFCGPHEINHFFCEILSVLKLACADTWLNQVVIFAACVFILVGPLCLVLVSYLRILAAILRIQSGEGRRKAFSTCSSHLCVVGLFFGSAIVTYMAPKSRHPEEQQKVLSLFYSLFNPMLNPLIYSLRNAEVKGALRRALRKER

SEQ ID NO: 59625 - protein, 318 aa, Homo sapiens
  Payload ID: 11709
  Gene Symbol: OR2A2
  Gene Name: olfactory receptor, family 2, subfamily A, member 2
  Uniprot ID: Q6IF42
  ENSP ID: ENSP00000386209
MEGNQTWITDITLLGFQVGPALAILLCGLFSVFYTLTLLGNGVIFGIICLDSKLHTPMYFFLSHLAIIDMSYASNNVPKMLANLMNQKRTISFVPCIMQTFLYLAFAVTECLILVVMSYDRYVAICHPFQYTVIMSWRVCTILVLTSWSCGFALSLVHEILLLRLPFCGPRDVNHLFCEILSVLKLACADTWVNQVVIFATCVFVLVGPLSLILVSYMHILGAILKIQTKEGRIKAFSTCSSHLCVVGLFFGIAMVVYMVPDSNQREEQEKMLSLFHSVFNPMLNPLIYSLRNAQLKGALHRALQRKRSMRTVYGLCL

SEQ ID NO: 59626 - protein, 310 aa, Homo sapiens
  Payload ID: 11710
  Gene Symbol: OR2A25
  Gene Name: olfactory receptor, family 2, subfamily A, member 25
  Uniprot ID: A4D2G3
  ENSP ID: ENSP00000386167
MGGNQTSITEFLLLGFPIGPRIQMLLFGLFSLFYIFILLGNGTILGLISLDSRLHTPMYFFLSHLAVVDIACACSTVPQMLVNLLHPAKPISFAGCMTQMFLFLSFAHTECLLLVVMSYDRYVAICHPLRYSTIMTWKVCITLALTSWILGVLLALVHLVLLLPLSFCGPQKLNHFFCEIMAVLKLACADTHINEVMVLAGAVSVLVGAFFSTVISYVHILCAILKIQSGEGCQKAFSICSSHLCVVGLFYGTAIIMYVEPQYESPKEQKKYLLLFHSLFNPMLNPLIYSLRNKEVQGTLKRMLEKKRTS

SEQ ID NO: 59627 - protein, 310 aa, Homo sapiens
  Payload ID: 11711
  Gene Symbol: OR2A4
  Gene Name: olfactory receptor, family 2, subfamily A, member 4
  Uniprot ID: O95047
  ENSP ID: ENSP00000319546
MGDNITSIREFLLLGFPVGPRIQMLLFGLFSLFYVFTLLGNGTILGLISLDSRLHAPMYFFLSHLAVVDIAYACNTVPRMLVNLLHPAKPISFAGRMMQTFLFSTFAVTECLLLVVMSYDLYVAICHPLRYLAIMTWRVCITLAVTSWTTGVLLSLIHLVLLLPLPFCRPQKIYHFFCEILAVLKLACADTHINENMVLAGAISGLVGPLSTIVVSYMCILCAILQIQSREVQRKAFRTCFSHLCVIGLVYGTAIIMYVGPRYGNPKEQKKYLLLFHSLFNPMLNPLICSLRNSEVKNTLKRVLGVERAL

SEQ ID NO: 59628 - protein, 310 aa, Homo sapiens; identical to SEQ ID NO: 59621
  Payload ID: 11712
  Gene Symbol: OR2A42
  Gene Name: olfactory receptor, family 2, subfamily A, member 42
  Uniprot ID: Q8NGT9
  ENSP ID: ENSP00000375334

SEQ ID NO: 59629 - protein, 311 aa, Homo sapiens
  Payload ID: 11713
  Gene Symbol: OR2A5
  Gene Name: olfactory receptor, family 2, subfamily A, member 5
  Uniprot ID: Q96R48
  ENSP ID: ENSP00000386208
MTKNQTWVTEFILLGFPLSLRIQMLLSGLFSLLYVFTLLGNGAILGLIWLDSRLHTPMYFFLSHLAIIDISYASNNVPKMLTNLGLNKRKTISFVPCTMQTFLYMAFAHTECLILVMMSYDRYMAICHPLQYSVIMRWGVCTVLAVTSWACGSLLALVHVVLILRLPFCGPHEINHFFCEILSVLKLACADTWLNQVVIFAASVFILVGPLCLVLVSYSRILAAILRIQSGEGRRKAFSTCSSHLCMVGLFFGSAIVMYMAPKSRHPEEQQKVLSLFYSLFNPMLNPLIYSLRNAEVKGALKRVLWKQRSK

SEQ ID NO: 59630 - protein, 310 aa, Homo sapiens
  Payload ID: 11714
  Gene Symbol: OR2A7
  Gene Name: olfactory receptor, family 2, subfamily A, member 7
  Uniprot ID: Q96R45
  ENSP ID: ENSP00000420502
MGDNITSITEFLLLGFPVGPRIQMLLFGLFSLFYVFTLLGNGTILGLISLDSRLHAPMYFFLSHLAVVDIAYACNTVPRMLVNLLHPAKPISFAGRMMQTFLFSTFAVTECLLLVVMSYDLYVAICHPLRYLAIMTWRVCITLAVTSWTTGVLLSLIHLVLLLPLPFCRPQKIYHFFCEILAVLKLACADTHINENMVLAGAISGLVGPLSTIVVSYMCILCAILQIQSREVQRKAFCTCFSHLCVIGLFYGTAIIMYVGPRYGNPKEQKKYLLLFHSLFNPMLNPLICSLRNSEVKNTLKRVLGVERAL

SEQ ID NO: 59631 - protein, 323 aa, Homo sapiens
  Payload ID: 11715
  Gene Symbol: OR2AE1
  Gene Name: olfactory receptor, family 2, subfamily AE, member 1
  Uniprot ID: Q8NHA4
  ENSP ID: ENSP00000313936
MWQKNQTSLADFILEGLFDDSLTHLFLFSLTMVVFLIAVSGNTLTILLICIDPQLHTPMYFLLSQLSLMDLMHVSTIILKMATNYLSGKKSISFVGCATQHFLYLCLGGAECFLLAVMSYDRYVAICHPLRYAVLMNKKVGLMMAVMSWLGASVNSLIHMAILMHFPFCGPRKVYHFYCEFPAVVKLVCGDITVYETTVYISSILLLLPIFLISTSYVFILQSVIQMRSSGSKRNAFATCGSHLTVVSLWFGACIFSYMRPRSQCTLLQNKVGSVFYSIITPTLNSLIYTLRNKDVAKALRRVLRRDVITQCIQRLQLWLPRV

SEQ ID NO: 59632 - protein, 316 aa, Homo sapiens
  Payload ID: 11716
  Gene Symbol: OR2AG1
  Gene Name: olfactory receptor, family 2, subfamily AG, member 1 (gene/pseudogene)
  Uniprot ID: Q9H205
  ENSP ID: ENSP00000307447
MELWNFTLGSGFILVGILNDSGSPELLCATITILYLLALISNGLLLLAITMEARLHMPMYLLLGQLSLMDLLFTSVVTPKALADFLRRENTISFGGCALQMFLALTMGGAEDLLLAFMAYDRYVAICHPLTYMTLMSSRACWLMVATSWILASLSALIYTVYTMHYPFCRAQEIRHLLCEIPHLLKVACADTSRYELMVYVMGVTFLIPSLAAILASYTQILLTVLHMPSNEGRKKALVTCSSHLTVVGMFYGAATFMYVLPSSFHSTRQDNIISVFYTIVTPALNPLIYSLRNKEVMRALRRVLGKYMLPAHSTL

SEQ ID NO: 59633 - protein, 316 aa, Homo sapiens; identical to SEQ ID NO: 59632
  Payload ID: 11716
  Gene Symbol: OR2AG1
  Gene Name: olfactory receptor, family 2, subfamily AG, member 1 (gene/pseudogene)
  Uniprot ID: Q9H205
  ENSP ID: ENSP00000485214

SEQ ID NO: 59634 - protein, 316 aa, Homo sapiens; identical to SEQ ID NO: 59632
  Payload ID: 11716
  Gene Symbol: OR2AG1
  Gene Name: olfactory receptor, family 2, subfamily AG, member 1 (gene/pseudogene)
  Uniprot ID: Q9H205
  ENSP ID: ENSP00000485326

SEQ ID NO: 59635 - protein, 316 aa, Homo sapiens
  Payload ID: 11717
  Gene Symbol: OR2AG2
  Gene Name: olfactory receptor, family 2, subfamily AG, member 2
  Uniprot ID: A6NM03
  ENSP ID: ENSP00000342697
MELRNSTLGSGFILVGILNDSGSPELLYATFTILYMLALTSNGLLLLAITIEARLHMPMYLLLGQLSLMDLLFTSVVTPKALADFLRRENTISFGGCALQMFLALTMGSAEDLLLAFMAYDRYVAICHPLKYMTLMSPRVCWIMVATSWILASLIAIGHTMYTMHLPFCVSWEIRHLLCEIPPLLKLACADTSRYELIIYVTGVTFLLLPISAIVASYTLVLFTVLRMPSNEGRKKALVTCSSHLIVVGMFYGAATFMYVLPSSFHSPKQDNIISVFYTIVTPALNPLIYSLRNKEVMRALRRVLGKYILLAHSTL

SEQ ID NO: 59636 - protein, 328 aa, Homo sapiens
  Payload ID: 11718
  Gene Symbol: OR2AJ1
  Gene Name: olfactory receptor, family 2, subfamily AJ, member 1
  Uniprot ID: Q8NGZ0
  ENSP ID: ENSP00000325078
MGHQNHTFSSDFILLGLFSSSPTSVVFFLVLFVIFIMSVTENTLMILLIRSDSRLHTPMYFLLSHLSLMDILHVSNIVPKMVTNFLSGSRTISFAGCGFQVFLSLTLLGGECLLLAAMSCDRYVAICHPLRYPILMKEYASALMAGGSWLIGVFNSTVHTAYALQFPFCGSRAIDHFFCEVPAMLKLSCADTTRYERGVCVSAVIFLLIPFSLISASYGQIILTVLQMKSSEARKKSFSTCSFHMIVVTMYYGPFIFTYMRPKSYHTPGQDKFLAIFYTILTPTLNPFIYSFRNKDVLAVMKNMLKSNFLHKKMNRKIPECVFCLFLC

SEQ ID NO: 59637 - protein, 335 aa, Homo sapiens
  Payload ID: 11719
  Gene Symbol: OR2AK2
  Gene Name: olfactory receptor, family 2, subfamily AK, member 2
  Uniprot ID: Q8NG84
  ENSP ID: ENSP00000355436
MNISDVISFDILVSAMKTGNQSFGTDFLLVGLFQYGWINSLLFVVIATLFTVALTGNIMLIHLIRLNTRLHTPMYFLLSQLSIVDLMYISTTVPKMAVSFLSQSKTIRFLGCEIQTYVFLALGGTEALLLGFMSYDRYVAICHPLHYPMLMSKKICCLMVACAWASGSINAFIHTLYVFQLPFCRSRLINHFFCEVPALLSLVCQDTSQYEYTVLLSGLIILLLPFLAILASYARVLIVVFQMSSGKGQAKAVSTCSSHLIVASLFYATTLFTYTRPHSLRSPSRDKAVAVFYTIVTPLLNPFIYSLRNKEVTGAVRRLLGYWICCRKYDFRSLY

SEQ ID NO: 59638 - protein, 309 aa, Homo sapiens
  Payload ID: 11720
  Gene Symbol: OR2AP1
  Gene Name: olfactory receptor, family 2, subfamily AP, member 1
  Uniprot ID: Q8NGE2
  ENSP ID: ENSP00000323423
MKNKTVLTEFILLGLTDVPELQVAVFTFLFLAYLLSILGNLTILILTLLDSHLQTPMYFFLRNFSFLEISFTNIFIPRVLISITTGNKSISFAGCFTQYFFAMFLGATEFYLLAAMSYDRYVAICKPLHYTTIMSSRICIQLIFCSWLGGLMAIIPTITLMSQQDFCASNRLNHYFCDYEPLLELSCSDTSLIEKVVFLVASVTLVVTLVLVILSYAFIIKTILKLPSAQQRTKAFSTCSSHMIVISLSYGSCMFMYINPSAKEGDTFNKGVALLITSVAPLLNPFIYTLRNQQVKQPFKDMVKKLLNL

SEQ ID NO: 59639 - protein, 320 aa, Homo sapiens
  Payload ID: 11721
  Gene Symbol: OR2AT4
  Gene Name: olfactory receptor, family 2, subfamily AT, member 4
  Uniprot ID: A6NND4
  ENSP ID: ENSP00000304846
MDATACNESVDGSPVFYLLGIPSLPETFFLPVFFIFLLFYLLILMGNALILVAVVAEPSLHKPMYFFLINLSTLDILFTTTTVPKMLSLFLLGDRFLSFSSCLLQMYLFQSFTCSEAFILVVMAYDRYVAICHPLHYPVLMNPQTNATLAASAWLTALLLPIPAVVRTSQMAYNSIAYIYHCFCDHLAVVQASCSDTTPQTLMGFCIAMVVSFLPLLLVLLSYVHILASVLRISSLEGRAKAFSTCSSHLLVVGTYYSSIAIAYVAYRADLPLDFHIMGNVVYAILTPILNPLIYTLRNRDVKAAITKIMSQDPGCDRSI

SEQ ID NO: 59640 - protein, 317 aa, Homo sapiens
  Payload ID: 11722
  Gene Symbol: OR2B11
  Gene Name: olfactory receptor, family 2, subfamily B, member 11
  Uniprot ID: Q5JQS5
  ENSP ID: ENSP00000325682
MKSDNHSFLGDSPKAFILLGVSDRPWLELPLFVVLLLSYVLAMLGNVAIILASRVDPQLHSPMYIFLSHLSFLDLCYTTTTVPQMLVNMGSSQKTISYGGCTVQYAVFHWLGCTECIVLAAMALDRYVAICKPLHYAVLMHRALCQQLVALAWLSGFGNSFVQVVLTVQLPFCGRQVLNNFFCEVPAVIKLSCADTAVNDTILAVLVAFFVLVPLALILLSYGFIARAVLRIQSSKGRHKAFGTCSSHLMIVSLFYLPAIYMYLQPPSSYSQEQGKFISLFYSIITPTLNPFTYTLRNKDMKGALRRLLARIWRLCG

SEQ ID NO: 59641 - protein, 357 aa, Homo sapiens
  Payload ID: 11723
  Gene Symbol: OR2B2
  Gene Name: olfactory receptor, family 2, subfamily B, member 2
  Uniprot ID: Q9GZK3
  ENSP ID: ENSP00000304419
MNWVNKSVPQEFILLVFSDQPWLEIPPFVMFLFSYILTIFGNLTIILVSHVDFKLHTPMYFFLSNLSLLDLCYTTSTVPQMLVNICNTRKVISYGGCVAQLFIFLALGSTECLLLAVMCFDRFVAICRPLHYSIIMHQRLCFQLAAASWISGFSNSVLQSTWTLKMPLCGHKEVDHFFCEVPALLKLSCVDTTANEAELFFISVLFLLIPVTLILISYAFIVQAVLRIQSAEGQRKAFGTCGSHLIVVSLFYGTAISMYLQPPSPSSKDRGKMVSLFCGIIAPMLNPLIYTLRNKEVKEAFKRLVAKSLLNQEIRNMQMISFAKDTVLTYLTNFSASCPIFVITIENYCNLPQRKFP

SEQ ID NO: 59642 - protein, 313 aa, Homo sapiens
  Payload ID: 11724
  Gene Symbol: OR2B3
  Gene Name: olfactory receptor, family 2, subfamily B, member 3
  Uniprot ID: O76000
  ENSP ID: ENSP00000366378
MNWENESSPKEFILLGFSDRAWLQMPLFVVLLISYTITIFGNVSIMMVCILDPKLHTPMYFFLTNLSILDLCYTTTTVPHMLVNIGCNKKTISYAGCVAHLIIFLALGATECLLLAVMSFDRYVAVCRPLHYVVIMNYWFCLRMAAFSWLIGFGNSVLQSSLTLNMPRCGHQEVDHFFCEVPALLKLSCADTKPIEAELFFFSVLILLIPVTLILISYGFIAQAVLKIRSAEGRQKAFGTCGSHMIVVSLFYGTAIYMYLQPPSSTSKDWGKMVSLFYGIITSMLNSLIYSLRNKDMKEAFKRLMPRIFFCKK

SEQ ID NO: 59643 - protein, 313 aa, Homo sapiens; identical to SEQ ID NO: 59642
  Payload ID: 11724
  Gene Symbol: OR2B3
  Gene Name: olfactory receptor, family 2, subfamily B, member 3
  Uniprot ID: O76000
  ENSP ID: ENSP00000373149

SEQ ID NO: 59644 - protein, 313 aa, Homo sapiens; identical to SEQ ID NO: 59642
  Payload ID: 11724
  Gene Symbol: OR2B3
  Gene Name: olfactory receptor, family 2, subfamily B, member 3
  Uniprot ID: O76000
  ENSP ID: ENSP00000388604

SEQ ID NO: 59645 - protein, 313 aa, Homo sapiens; identical to SEQ ID NO: 59642
  Payload ID: 11724
  Gene Symbol: OR2B3
  Gene Name: olfactory receptor, family 2, subfamily B, member 3
  Uniprot ID: O76000
  ENSP ID: ENSP00000393235

SEQ ID NO: 59646 - protein, 313 aa, Homo sapiens; identical to SEQ ID NO: 59642
  Payload ID: 11724
  Gene Symbol: OR2B3
  Gene Name: olfactory receptor, family 2, subfamily B, member 3
  Uniprot ID: O76000
  ENSP ID: ENSP00000394571

SEQ ID NO: 59647 - protein, 313 aa, Homo sapiens; identical to SEQ ID NO: 59642
  Payload ID: 11724
  Gene Symbol: OR2B3
  Gene Name: olfactory receptor, family 2, subfamily B, member 3
  Uniprot ID: O76000
  ENSP ID: ENSP00000394593

SEQ ID NO: 59648 - protein, 313 aa, Homo sapiens; identical to SEQ ID NO: 59642
  Payload ID: 11724
  Gene Symbol: OR2B3
  Gene Name: olfactory receptor, family 2, subfamily B, member 3
  Uniprot ID: O76000
  ENSP ID: ENSP00000399881

SEQ ID NO: 59649 - protein, 313 aa, Homo sapiens; identical to SEQ ID NO: 59642
  Payload ID: 11724
  Gene Symbol: OR2B3
  Gene Name: olfactory receptor, family 2, subfamily B, member 3
  Uniprot ID: O76000
  ENSP ID: ENSP00000403571

SEQ ID NO: 59650 - protein, 313 aa, Homo sapiens
  Payload ID: 11725
  Gene Symbol: OR2B6
  Gene Name: olfactory receptor, family 2, subfamily B, member 6
  Uniprot ID: P58173
  ENSP ID: ENSP00000244623
MNWVNDSIIQEFILLGFSDRPWLEFPLLVVFLISYTVTIFGNLTIILVSRLDTKLHTPMYFFLTNLSLLDLCYTTCTVPQMLVNLCSIRKVISYRGCVAQLFIFLALGATEYLLLAVMSFDRFVAICRPLHYSVIMHQRLCLQLAAASWVTGFSNSVWLSTLTLQLPLCDPYVIDHFLCEVPALLKLSCVETTANEAELFLVSELFHLIPLTLILISYAFIVRAVLRIQSAEGRQKAFGTCGSHLIVVSLFYSTAVSVYLQPPSPSSKDQGKMVSLFYGIIAPMLNPLIYTLRNKEVKEGFKRLVARVFLIKK

SEQ ID NO: 59651 - protein, 312 aa, Homo sapiens
  Payload ID: 11726
  Gene Symbol: OR2C1
  Gene Name: olfactory receptor, family 2, subfamily C, member 1
  Uniprot ID: O95371
  ENSP ID: ENSP00000307726
MDGVNDSSLQGFVLMGISDHPQLEMIFFIAILFSYLLTLLGNSTIILLSRLEARLHTPMYFFLSNLSSLDLAFATSSVPQMLINLWGPGKTISYGGCITQLYVFLWLGATECILLVVMAFDRYVAVCRPLRYTAIMNPQLCWLLAVIACLGGLGNSVIQSTFTLQLPLCGHRRVEGFLCEVPAMIKLACGDTSLNQAVLNGVCTFFTAVPLSIIVISYCLIAQAVLKIRSAEGRRKAFNTCLSHLLVVFLFYGSASYGYLLPAKNSKQDQGKFISLFYSLVTPMVNPLIYTLRNMEVKGALRRLLGKGREVG

SEQ ID NO: 59652 - protein, 320 aa, Homo sapiens
  Payload ID: 11727
  Gene Symbol: OR2C3
  Gene Name: olfactory receptor, family 2, subfamily C, member 3
  Uniprot ID: Q8N628
  ENSP ID: ENSP00000355443
MMEIANVSSPEVFVLLGFSTRPSLETVLFIVVLSFYMVSILGNGIIILVSHTDVHLHTPMYFFLANLPFLDMSFTTSIVPQLLANLWGPQKTISYGGCVVQFYISHWLGATECVLLATMSYDRYAAICRPLHYTVIMHPQLCLGLALASWLGGLTTSMVGSTLTMLLPLCGNNCIDHFFCEMPLIMQLACVDTSLNEMEMYLASFVFVVLPLGLILVSYGHIARAVLKIRSAEGRRKAFNTCSSHVAVVSLFYGSIIFMYLQPAKSTSHEQGKFIALFYTVVTPALNPLIYTLRNTEVKSALRHMVLENCCGSAGKLAQI

SEQ ID NO: 59653 - protein, 320 aa, Homo sapiens; identical to SEQ ID NO: 59652
  Payload ID: 11727
  Gene Symbol: OR2C3
  Gene Name: olfactory receptor, family 2, subfamily C, member 3
  Uniprot ID: Q8N628
  ENSP ID: ENSP00000479757

SEQ ID NO: 59654 - protein, 308 aa, Homo sapiens
  Payload ID: 11728
  Gene Symbol: OR2D2
  Gene Name: olfactory receptor, family 2, subfamily D, member 2
  Uniprot ID: Q9H210
  ENSP ID: ENSP00000299459
MRQINQTQVTEFLLLGLSDGPHTEQLLFIVLLGVYLVTVLGNLLLISLVHVDSQLHTPMYFFLCNLSLADLCFSTNIVPQALVHLLSRKKVIAFTLCAARLLFFLIFGCTQCALLAVMSYDRYVAICNPLRYPNIMTWKVCVQLATGSWTSGILVSVVDTTFILRLPYRGSNSIAHFFCEAPALLILASTDTHASEMAIFLMGVVILLIPVFLILVSYGRIIVTVVKMKSTVGSLKAFSTCGSHLMVVILFYGSAIITYMTPKSSKQQEKSVSVFYAIVTPMLNPLIYSLRNKDVKAALRKVATRNFP

SEQ ID NO: 59655 - protein, 330 aa, Homo sapiens
  Payload ID: 11729
  Gene Symbol: OR2D3
  Gene Name: olfactory receptor, family 2, subfamily D, member 3
  Uniprot ID: Q8NGH3
  ENSP ID: ENSP00000320560
MCSFFLCQTGKQAKISMGEENQTFVSKFIFLGLSQDLQTQILLFILFLIIYLLTVLGNQLIIILIFLDSRLHTPMYFFLRNLSFADLCFSTSIVPQVLVHFLVKRKTISFYGCMTQIIVFLLVGCTECALLAVMSYDRYVAVCKPLYYSTIMTQRVCLWLSFRSWASGALVSLVDTSFTFHLPYWGQNIINHYFCEPPALLKLASIDTYSTEMAIFSMGVVILLAPVSLILGSYWNIISTVIQMQSGEGRLKAFSTCGSHLIVVVLFYGSGIFTYMRPNSKTTKELDKMISVFYTAVTPMLNPIIYSLRNKDVKGALRKLVGRKCFSHRQ

SEQ ID NO: 59656 - protein, 317 aa, Homo sapiens; identical to SEQ ID NO: 969
  Payload ID: 11730
  Gene Symbol: OR2F1
  Gene Name: olfactory receptor, family 2, subfamily F, member 1 (gene/pseudogene)
  Uniprot ID: Q13607
  ENSP ID: ENSP00000376633

SEQ ID NO: 59657 - protein, 317 aa, Homo sapiens; identical to SEQ ID NO: 969
  Payload ID: 11730
  Gene Symbol: OR2F1
  Gene Name: olfactory receptor, family 2, subfamily F, member 1 (gene/pseudogene)
  Uniprot ID: Q13607
  ENSP ID: ENSP00000485483

SEQ ID NO: 59658 - protein, 317 aa, Homo sapiens
  Payload ID: 11731
  Gene Symbol: OR2F2
  Gene Name: olfactory receptor, family 2, subfamily F, member 2
  Uniprot ID: O95006
  ENSP ID: ENSP00000386222
MEIDNQTWVREFILLGLSSDWCTQISLFSLFLVTYLMTVLGNCLIVLLIRLDSRLHTPMYFFLTNLSLVDVSYATSVVPQLLAHFLAEHKAIPFQSCAAQLFFSLALGGIEFVLLAVMAYDRHVAVSDRLRYSAIMHGGLCARLAITSWVSGSINSLVQTAITFQLPMCTNKFIDHISCELLAVVRLACVDTSSNEAAIMVSSIVLLMTPFCLVLLSYIRIISTILKIQSREGRKKAFHTCASHLTVVALCYGTTIFTYIQPHSGPSVLQEKLISVFYAIVMPLLNPVIYSLRNKEVKGAWHKLLEKFSGLTSKLGT

SEQ ID NO: 59659 - protein, 317 aa, Homo sapiens
  Payload ID: 11732
  Gene Symbol: OR2G2
  Gene Name: olfactory receptor, family 2, subfamily G, member 2
  Uniprot ID: Q8NGZ5
  ENSP ID: ENSP00000326349
MGMVRHTNESNLAGFILLGFSDYPQLQKVLFVLILILYLLTILGNTTIILVSRLEPKLHMPMYFFLSHLSFLYRCFTSSVIPQLLVNLWEPMKTIAYGGCLVHLYNSHALGSTECVLPAVMSCDRYVAVCRPLHYTVLMHIHLCMALASMAWLSGIATTLVQSTLTLQLPFCGHRQVDHFICEVPVLIKLACVGTTFNEAELFVASILFLIVPVSFILVSSGYIAHAVLRIKSATRRQKAFGTCFSHLTVVTIFYGTIIFMYLQPAKSRSRDQGKFVSLFYTVVTRMLNPLIYTLRIKEVKGALKKVLAKALGVNIL

SEQ ID NO: 59660 - protein, 309 aa, Homo sapiens
  Payload ID: 11733
  Gene Symbol: OR2G3
  Gene Name: olfactory receptor, family 2, subfamily G, member 3
  Uniprot ID: Q8NGZ4
  ENSP ID: ENSP00000326301
MGLGNESSLMDFILLGFSDHPRLEAVLFVFVLFFYLLTLVGNFTIIIISYLDPPLHTPMYFFLSNLSLLDICFTTSLAPQTLVNLQRPKKTITYGGCVAQLYISLALGSTECILLADMALDRYIAVCKPLHYVVIMNPRLCQQLASISWLSGLASSLIHATFTLQLPLCGNHRLDHFICEVPALLKLACVDTTVNELVLFVVSVLFVVIPPALISISYGFITQAVLRIKSVEARHKAFSTCSSHLTVVIIFYGTIIYVYLQPSDSYAQDQGKFISLFYTMVTPTLNPIIYTLRNKDMKEALRKLLSGKL

SEQ ID NO: 59661 - protein, 316 aa, Homo sapiens
  Payload ID: 11734
  Gene Symbol: OR2G6
  Gene Name: olfactory receptor, family 2, subfamily G, member 6
  Uniprot ID: Q5TZ20
  ENSP ID: ENSP00000341291
MEETNNSSEKGFLLLGFSDQPQLERFLFAIILYFYVLSLLGNTALILVCCLDSRLHTPMYFFLSNLSCVDICFTTSVAPQLLVTMNKKDKTMSYGGCVAQLYVAMGLGSSECILLAVMAYDRYAAVCRPLRYIAIMHPRFCASLAGGAWLSGLITSLIQCSLTVQLPLCGHRTLDHIFCEVPVLIKLACVDTTFNEAELFVASVVFLIVPVLLILVSYGFITQAVLRIKSAAGRQKAFGTCSSHLVVVIIFYGTIIFMYLQPANRRSKNQGKFVSLFYTIVTPLLNPIIYTLRNKDVKGALRTLILGSAAGQSHKD

SEQ ID NO: 59662 - protein, 316 aa, Homo sapiens
  Payload ID: 11735
  Gene Symbol: OR2H1
  Gene Name: olfactory receptor, family 2, subfamily H, member 1
  Uniprot ID: Q9GZK4
  ENSP ID: ENSP00000366336
MVNQSSPMGFLLLGFSEHPALERTLFVVVFTSYLLTLVGNTLIILLSVLYPRLHSPMYFFLSDLSFLDLCFTTSCVPQMLVNLWGPKKTISFLGCSVQLFIFLSLGTTECILLTVMAFDRYVAVCQPLHYATIIHPRLCWQLASVAWVMSLVQSIVQTPSTLHLPFCPHQQIDDFLCEVPSLIRLSCGDTSYNEIQLAVSSVIFVVVPLSLILASYGATAQAVLRINSATAWRKAFGTCSSHLTVVTLFYSSVIAVYLQPKNPYAQGRGKFFGLFYAVGTPSLNPLVYTLRNKEIKRALRRLLGKERDSRESWRAA

SEQ ID NO: 59663 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000366337

SEQ ID NO: 59664 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000366340

SEQ ID NO: 59665 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000373042

SEQ ID NO: 59666 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000373140

SEQ ID NO: 59667 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000380010

SEQ ID NO: 59668 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000383527

SEQ ID NO: 59669 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000383529

SEQ ID NO: 59670 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000383530

SEQ ID NO: 59671 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000383547

SEQ ID NO: 59672 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000383548

SEQ ID NO: 59673 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000383549

SEQ ID NO: 59674 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000388844

SEQ ID NO: 59675 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000389230

SEQ ID NO: 59676 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000392619

SEQ ID NO: 59677 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000394698

SEQ ID NO: 59678 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000395567

SEQ ID NO: 59679 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000395850

SEQ ID NO: 59680 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000395934

SEQ ID NO: 59681 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000396414

SEQ ID NO: 59682 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000396944

SEQ ID NO: 59683 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000397171

SEQ ID NO: 59684 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000398695

SEQ ID NO: 59685 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000405714

SEQ ID NO: 59686 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000407739

SEQ ID NO: 59687 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000408584

SEQ ID NO: 59688 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000409651

SEQ ID NO: 59689 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000410401

SEQ ID NO: 59690 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000410659

SEQ ID NO: 59691 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000411617

SEQ ID NO: 59692 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000412463

SEQ ID NO: 59693 - protein, 316 aa, Homo sapiens; identical to SEQ ID NO: 59662
  Payload ID: 11735
  Gene Symbol: OR2H1
  Gene Name: olfactory receptor, family 2, subfamily H, member 1
  Uniprot ID: Q9GZK4
  ENSP ID: ENSP00000413910

SEQ ID NO: 59694 - protein, 312 aa, Homo sapiens
  Payload ID: 11736
  Gene Symbol: OR2H2
  Gene Name: olfactory receptor, family 2, subfamily H, member 2
  Uniprot ID: O95918
  ENSP ID: ENSP00000366146
MVNQSSTPGFLLLGFSEHPGLERTLFVVVLTSYLLTLVGNTLIILLSALDPKLHSPMYFFLSNLSFLDLCFTTSCVPQMLVNLWGPKKTISFLDCSVQIFIFLSLGTTECILLTVMAFDRYVAVCQPLHYATIIHPRLCWQLASVAWVIGLVESVVQTPSTLHLPFCPDRQVDDFVCEVPALIRLSCEDTSYNEIQVAVASVFILVVPLSLILVSYGAITWAVLRINSAKGRRKAFGTCSSHLTVVTLFYSSVIAVYLQPKNPYAQERGKFFGLFYAVGTPSLNPLIYTLRNKEVTRAFRRLLGKEMGLTQS

SEQ ID NO: 59695 - protein, 312 aa, Homo sapiens
  Payload ID: 11736
  Gene Symbol: OR2H2
  Gene Name: olfactory receptor, family 2, subfamily H, member 2
  Uniprot ID: O95918
  ENSP ID: ENSP00000373038
MVNQSSTPGFLLLGFSEHPGLERTLFVVVFTSYLLTLVGNTLIILLSVLDPKLHSPMYFFLSNLSFLDLCFTTSCVPQMLVNLWGPKKTISFLDCSVQIFIFLSLGTTECILLTVMAFDRYVAVCQPLHYATIIHPRLCWQLASVAWVIGLVESVVQTPSTLHLPFCPDRQVDDFVCEVPALIRLSCEDTSYNEIQVAVASVFILVVPLSLILVSYGAITWAVLRINSAKGRRKAFGTCSSHLTVVTLFYSSVIAVYLQPKNPYAQERGKFFGLFYAVGTPSLNPLIYTLRNKEVTRAFRRLLGKEMGLTQS

SEQ ID NO: 59696 - protein, 312 aa, Homo sapiens; identical to SEQ ID NO: 59694
  Payload ID: 11736
  Gene Symbol: OR2H2
  Gene Name: olfactory receptor, family 2, subfamily H, member 2
  Uniprot ID: O95918
  ENSP ID: ENSP00000373136

SEQ ID NO: 59697 - protein, 312 aa, Homo sapiens
  Payload ID: 11736
  Gene Symbol: OR2H2
  Gene Name: olfactory receptor, family 2, subfamily H, member 2
  Uniprot ID: O95918
  ENSP ID: ENSP00000403604
MVNQSSTPGFLLLGFSEHPGLERTLFVVVFTSYLLTLVGNTLIILLSALDPKLHSPMYFFLSNLSFLDLCFTTSCVPQMLVNLWGPKKTISFLDCSVQIFIFLSLGTTECILLTVMAFDRYVAVCQPLHYATIIHPRLCWQLASVAWVIGLVESVVQTPSTLHLPFCPDRQVDDFVCEVPALIRLSCEDTSYNEIQVAVASVFILVVPLSLILVSYGAITWAVLRINSAKGRRKAFGTCSSHLTVVTLFYSSVIAVYLQPKNPYAQERGKFFGLFYAVGTPSLNPLIYTLRNKEVTRAFRRLLGKEMGLTQS

SEQ ID NO: 59698 - protein, 312 aa, Homo sapiens; identical to SEQ ID NO: 59695
  Payload ID: 11736
  Gene Symbol: OR2H2
  Gene Name: olfactory receptor, family 2, subfamily H, member 2
  Uniprot ID: O95918
  ENSP ID: ENSP00000409339

SEQ ID NO: 59699 - protein, 312 aa, Homo sapiens; identical to SEQ ID NO: 59694
  Payload ID: 11736
  Gene Symbol: OR2H2
  Gene Name: olfactory receptor, family 2, subfamily H, member 2
  Uniprot ID: O95918
  ENSP ID: ENSP00000410227

SEQ ID NO: 59700 - protein, 312 aa, Homo sapiens; identical to SEQ ID NO: 59695
  Payload ID: 11736
  Gene Symbol: OR2H2
  Gene Name: olfactory receptor, family 2, subfamily H, member 2
  Uniprot ID: O95918
  ENSP ID: ENSP00000414688

SEQ ID NO: 59701 - protein, 312 aa, Homo sapiens
  Payload ID: 11737
  Gene Symbol: OR2J1
  Gene Name: olfactory receptor, family 2, subfamily J, member 1 (gene/pseudogene)
  Uniprot ID: Q9GZK6
  ENSP ID: ENSP00000366376
MLMKKNASFEDFFLLLGFSNWPHLEVVLFVVILIFYLITLIGNLFIIILSYLDSHLHTPMYFFLSNLSFLDLCYTTSSIPQLLVNLWGPEKTISYAGCTVQLYFVLALGTAECVLLVVMSYDRYAAVCRPLHYTVLMHPRFCRLLAAASWVSGFTTSALHSSFTFWIPLCRHRLVDHFFCEVPALLRLSCVDTQANELTLMVMSSIFVLIPLILILTSYGAIARAVLSMQSTTGLQKVLRTCGAHLMVVSLFFIPVMCMYLQPPSENSQDQGKFIALFYTVVTPSLNPLIYTFRNKDVRGAVKRLMGWEWGM

SEQ ID NO: 59702 - protein, 312 aa, Homo sapiens
  Payload ID: 11737
  Gene Symbol: OR2J1
  Gene Name: olfactory receptor, family 2, subfamily J, member 1 (gene/pseudogene)
  Uniprot ID: Q9GZK6
  ENSP ID: ENSP00000414527
MLMKKNASFEDFFILLGFSNWPHLEVVLFVVILIFYLITLIGNLFIIILSYLDSHLHTPMYFFLSNLSFLDLCYTTSSIPQLLVNLWGPEKTISYAGCTVQLYFVLALGTAECVLLVVMSYDRYAAVCRPLHYTVLMHPRFCRLLAAASWVSGFTTSALHSSFTFWIPLCRHRLVDHFFCEVPALLRLSCVDTQANELTLMVMSSIFVLIPLILILTSYGAIARAVLSMQSTTGLQKVLRTCGAHLMVVSLFFIPVMCMYLQPPSENSQDQGKFIALFYTVVTPSLNPLIYTFRNKDVRGAVKRLMGWEWGM

SEQ ID NO: 59703 - protein, 312 aa, Homo sapiens
  Payload ID: 11738
  Gene Symbol: OR2J2
  Gene Name: olfactory receptor, family 2, subfamily J, member 2
  Uniprot ID: O76002
  ENSP ID: ENSP00000351519
MMIKKNASSEDFFILLGFSNWPQLEVVLFVVILIFYLMTLTGNLFIIILSYVDSHLHTPMYFFLSNLSFLDLCYTTSSIPQLLVNLRGPEKTISYAGCMVQLYFVLALGIAECVLLVVMSYDRYVAVCRPLHYTVLMHPRFCHLLVAASWVIGFTISALHSSFTFWVPLCGHRLVDHFFCEVPALLRLSCVDTHANELTLMVMSSIFVLIPLILILTTYGAIARAVLSMQSTTGLQKVFRTCGAHLMVVSLFFIPVMCMYLQPPSENSPDQGKFIALFYTVVTPSLNPLIYTLRNKHVKGAAKRLLGWEWGK

SEQ ID NO: 59704 - protein, 312 aa, Homo sapiens
  Payload ID: 11738
  Gene Symbol: OR2J2
  Gene Name: olfactory receptor, family 2, subfamily J, member 2
  Uniprot ID: O76002
  ENSP ID: ENSP00000366372
MMIKKNASSEDFFILLGFSNWPQLEVVLFVVILIFYLMTLTGNLFIIILSYVDSHLHTPMYFFLSNLSFLDLCYTTSSIPQLLVNLRGPEKTISYAGCMVQLYFVLALGITECVLLVVMSYDRYVAVCRPLHYTVLMHPRFCHLLVAASWVIGFTISALHSSFTFWVPLCGHRLVDHFFCEVPALLRLSCVDTHANELTLMVMSSIFVLIPLILILTTYGAIARAVLSMQSTTGLQKVFRTCGAHLMVVSLFFIPVMCMYLQPPSENSPDQGKFIALFYTVVTPSLNPLIYTLRNKHVKGAAKRLLGWEWGK

SEQ ID NO: 59705 - protein, 312 aa, Homo sapiens
  Payload ID: 11738
  Gene Symbol: OR2J2
  Gene Name: olfactory receptor, family 2, subfamily J, member 2
  Uniprot ID: O76002
  ENSP ID: ENSP00000392497
MMIKKNASSEDFFILLGFSNWPQLEVVLFVVILIFYLMTLTGNLFIIILSYVDSHLHTPMYFFLSNLSFLDLCHTTSSIPQLLVNLRGPEKTISYAGCMVQLYFVLALGIAECVLLVVMSYDRYVAVCRPLHYTVLMHPRFCHLLAAASWVIGFTISALHSSFTFWVPLCGHRLVDHFFCEVPALLRLSCVDTHANELTLMVMSSIFVLIPLILILTAYGAIARAVLSMQSTTGLQKVFRTCGAHLMVVSLFFIPVMCMYLQPPSENSPDQGKFIALFYTVVTPSLNPLIYTLRNKHVKGAAKRLLGWEWGK

SEQ ID NO: 59706 - protein, 312 aa, Homo sapiens; identical to SEQ ID NO: 59703
  Payload ID: 11738
  Gene Symbol: OR2J2
  Gene Name: olfactory receptor, family 2, subfamily J, member 2
  Uniprot ID: O76002
  ENSP ID: ENSP00000396524

SEQ ID NO: 59707 - protein, 312 aa, Homo sapiens; identical to SEQ ID NO: 59705
  Payload ID: 11738
  Gene Symbol: OR2J2
  Gene Name: olfactory receptor, family 2, subfamily J, member 2
  Uniprot ID: O76002
  ENSP ID: ENSP00000398238

SEQ ID NO: 59708 - protein, 312 aa, Homo sapiens; identical to SEQ ID NO: 59705
  Payload ID: 11738
  Gene Symbol: OR2J2
  Gene Name: olfactory receptor, family 2, subfamily J, member 2
  Uniprot ID: O76002
  ENSP ID: ENSP00000403186

SEQ ID NO: 59709 - protein, 312 aa, Homo sapiens; identical to SEQ ID NO: 59705
  Payload ID: 11738
  Gene Symbol: OR2J2
  Gene Name: olfactory receptor, family 2, subfamily J, member 2
  Uniprot ID: O76002
  ENSP ID: ENSP00000408988

SEQ ID NO: 59710 - protein, 312 aa, Homo sapiens; identical to SEQ ID NO: 59705
  Payload ID: 11738
  Gene Symbol: OR2J2
  Gene Name: olfactory receptor, family 2, subfamily J, member 2
  Uniprot ID: O76002
  ENSP ID: ENSP00000416299

SEQ ID NO: 59711 - protein, 311 aa, Homo sapiens
  Payload ID: 11739
  Gene Symbol: OR2J3
  Gene Name: olfactory receptor, family 2, subfamily J, member 3
  Uniprot ID: O76001
  ENSP ID: ENSP00000366374
MNDDGKVNASSEGYFILVGFSNWPHLEVVIFVVVLIFYLMTLIGNLFIIILSYLDSHLHTPMYFFLSNLSFLDLCYTTSSIPQLLVNLWGPEKTISYAGCMIQLYFVLALGTTECVLLVVMSYDRYAAVCRPLHYTVLMHPRFCHLLAVASWVSGFTNSALHSSFTFWVPLCGHRQVDHFFCEVPALLRLSCVDTHVNELTLMITSSIFVLIPLILILTSYGAIVRAILRMQSTTGLQKVFGTCGAHLMAVSLFFIPAMCMYLQPPSGNSQDQGKFIALFYTVVTPSLNPLIYTLRNKVVRGAVKRLMGWE

SEQ ID NO: 59712 - protein, 311 aa, Homo sapiens
  Payload ID: 11739
  Gene Symbol: OR2J3
  Gene Name: olfactory receptor, family 2, subfamily J, member 3
  Uniprot ID: O76001
  ENSP ID: ENSP00000373147
MNDDGKVNASSEGYFILVGFSNWPHLEVVIFVVVLIFYLMTLIGNLFIIILSYLDSHLHTPMYFFLSNLSFLDLCYTTSSIPQLLVNLWGPEKTISYAGCMIQLYFVLALGTTECVLLVVMSYDRYAAVCRPLHYTVLMHPRFCHLLAVASWVSGFTNSALHSSFTFWVPLCGHRQVDHFFCEVPALLRLSCVDTHVNELTLMITSSIFVLIPLILILTSYGAIVRAVLRMQSTTGLQKVFGTCGAHLMAVSLFFIPAMCIYLQPPSGNSQDQGKFIALFYTVVTPSLNPLIYTLRNKVVRGAVKRLMGWE

SEQ ID NO: 59713 - protein, 311 aa, Homo sapiens; identical to SEQ ID NO: 59712
  Payload ID: 11739
  Gene Symbol: OR2J3
  Gene Name: olfactory receptor, family 2, subfamily J, member 3
  Uniprot ID: O76001
  ENSP ID: ENSP00000388205

SEQ ID NO: 59714 - protein, 311 aa, Homo sapiens; identical to SEQ ID NO: 59712
  Payload ID: 11739
  Gene Symbol: OR2J3
  Gene Name: olfactory receptor, family 2, subfamily J, member 3
  Uniprot ID: O76001
  ENSP ID: ENSP00000388392

SEQ ID NO: 59715 - protein, 311 aa, Homo sapiens; identical to SEQ ID NO: 59712
  Payload ID: 11739
  Gene Symbol: OR2J3
  Gene Name: olfactory receptor, family 2, subfamily J, member 3
  Uniprot ID: O76001
  ENSP ID: ENSP00000390144

SEQ ID NO: 59716 - protein, 258 aa, Homo sapiens
  Payload ID: 11739
  Gene Symbol: OR2J3
  Gene Name: olfactory receptor, family 2, subfamily J, member 3
  ENSP ID: ENSP00000393371
MNDDGKVNASSEGYFILVGFSNWPHLEVVIFVVVLIFYLMTLIGNLFIIILSYLDSHLHTPMYFFLSNLSFLDLCYTTSSIPQLLVNLWGPEKTISYAGCMIQLYFVLALGTTECVLLVVMSYDRYAAVCRPLHYTVLMHPRFCHLLAVASWVSGFTNSALHSSFTFWVPLCGHRQVDHFFCEVPALLRLSCVDTHVNELTLMITSSIFVLIPLILILTSYGAIVQAVLRMQSTTGLQKVFGTCGAHLMAVSLFFIPA

SEQ ID NO: 59717 - protein, 311 aa, Homo sapiens; identical to SEQ ID NO: 59712
  Payload ID: 11739
  Gene Symbol: OR2J3
  Gene Name: olfactory receptor, family 2, subfamily J, member 3
  Uniprot ID: O76001
  ENSP ID: ENSP00000400546

SEQ ID NO: 59718 - protein, 311 aa, Homo sapiens; identical to SEQ ID NO: 59712
  Payload ID: 11739
  Gene Symbol: OR2J3
  Gene Name: olfactory receptor, family 2, subfamily J, member 3
  Uniprot ID: O76001
  ENSP ID: ENSP00000408783

SEQ ID NO: 59719 - protein, 311 aa, Homo sapiens
  Payload ID: 11739
  Gene Symbol: OR2J3
  Gene Name: olfactory receptor, family 2, subfamily J, member 3
  ENSP ID: ENSP00000480572
MNDDGKVNASSEGYFILVGFSNWPHLEVVIFVVVLIFYLMTLIGNLFIIILSYLDSHLHTPMYFFLSNLSFLDLCYTTSSIPQLLVNLWGPEKTISYAGCMIQLYFVLALGTTECVLLVVMSYDRYAAVCRPLHYTVLMHPRFCHLLAVASWVSGFTNSALHSSFTFWVPLCGHRQVDHFFCEVPALLRLSCVDTHVNELTLMITSSIFVLIPLILILTSYGAIVQAVLRMQSTTGLQKVFGTCGAHLMAVSLFFIPAMCMYLQPPSGNSQDQGKFIALFYTVVTPSLNPLIYTLRNKDVRGVVKRLRGWE

SEQ ID NO: 59720 - protein, 316 aa, Homo sapiens
  Payload ID: 11740
  Gene Symbol: OR2K2
  Gene Name: olfactory receptor, family 2, subfamily K, member 2
  ENSP ID: ENSP00000305055
MQGENFTIWSIFFLEGFSQYPGLEVVLFVFSLVMYLTTLLGNSTLILITILDSRLKTPMYLFLGNLSFMDICYTSASVPTLLVNLLSSQKTIIFSGCAVQMYLSLAMGSTECVLLAVMAYDRYVAICNPLRYSIIMNRCVCARMATVSWVTGCLTALLETSFALQIPLCGNLIDHFTCEILAVLKLACTSSLLMNTIMLVVSILLLPIPMLLVCISYIFILSTILRITSAEGRNKAFSTCGAHLTVVILYYGAALSMYLKPSSSNAQKIDKIISLLYGVLTPMLNPIIYSLRNKEVKDAMKKLLGKITLHQTHEHL

SEQ ID NO: 59721 - protein, 345 aa, Homo sapiens
  Payload ID: 11740
  Gene Symbol: OR2K2
  Gene Name: olfactory receptor, family 2, subfamily K, member 2
  Uniprot ID: Q8NGT1
  ENSP ID: ENSP00000363550
MNITLYSFLYVLRLNEGNSTGRNIDERKKMQGENFTIWSIFFLEGFSQYPGLEVVLFVFSLVMYLTTLLGNSTLILITILDSRLKTPMYLFLGNLSFMDICYTSASVPTLLVNLLSSQKTIIFSGCAVQMYLSLAMGSTECVLLAVMAYDRYVAICNPLRYSIIMNRCVCARMATVSWVTGCLTALLETSFALQIPLCGNLIDHFTCEILAVLKLACTSSLLMNTIMLVVSILLLPIPMLLVCISYIFILSTILRITSAEGRNKAFSTCGAHLTVVILYYGAALSMYLKPSSSNAQKIDKIISLLYGVLTPMLNPIIYSLRNKEVKDAMKKLLGKITLHQTHEHL

SEQ ID NO: 59722 - protein, 312 aa, Homo sapiens
  Payload ID: 11741
  Gene Symbol: OR2L13
  Gene Name: olfactory receptor, family 2, subfamily L, member 13
  Uniprot ID: Q8N349
  ENSP ID: ENSP00000350836
MEKWNHTSNDFILLGLLPPNQTGIFLLCLIILIFFLASVGNSAMIHLIHVDPRLHTPMYFLLSQLSLMDLMYISTTVPKMAYNFLSGQKGISFLGCGVQSFFFLTMACSEGLLLTSMAYDRYLAICHSLYYPIRMSKMMCVKMIGGSWTLGSINSLAHTVFALHIPYCRSRAIDHFFCDVPAMLLLACTDTWVYEYMVFVSTSLFLLFPFIGITSSCGRVLFAVYHMHSKEGRKKAFTTISTHLTVVIFYYAPFVYTYLRPRNLRSPAEDKILAVFYTILTPMLNPIIYSLRNKEVLGAMRRVFGIFSFLKE

SEQ ID NO: 59723 - protein, 312 aa, Homo sapiens; identical to SEQ ID NO: 59722
  Payload ID: 11741
  Gene Symbol: OR2L13
  Gene Name: olfactory receptor, family 2, subfamily L, member 13
  Uniprot ID: Q8N349
  ENSP ID: ENSP00000355434

SEQ ID NO: 59724 - protein, 312 aa, Homo sapiens
  Payload ID: 11742
  Gene Symbol: OR2L2
  Gene Name: olfactory receptor, family 2, subfamily L, member 2
  Uniprot ID: Q8NH16
  ENSP ID: ENSP00000355435
MENYNQTSTDFILLGLFPQSRIGLFVFTLIFLIFLMALIGNLSMILLIFLDIHLHTPMYFLLSQLSLIDLNYISTIVPKMVYDFLYGNKSISFTGCGIQSFFFLTLAVAEGLLLTSMAYDRYVAICFPLHYPIRISKRVCVMMITGSWMISSINSCAHTVYALCIPYCKSRAINHFFCDVPAMLTLACTDTWVYESTVFLSSTIFLVLPFTGIACSYGRVLLAVYRMHSAEGRKKAYSTCSTHLTVVSFYYAPFAYTYVRPRSLRSPTEDKILAVFYTILTPMLNPIIYSLRNKEVMGALTQVIQKIFSVKM

SEQ ID NO: 59725 - protein, 312 aa, Homo sapiens
  Payload ID: 11743
  Gene Symbol: OR2L3
  Gene Name: olfactory receptor, family 2, subfamily L, member 3
  Uniprot ID: Q8NG85
  ENSP ID: ENSP00000353044
MENYNQTSTDFILLGFFPPSRIGLFLFILIVFIFLMALIGNLSMILLIFLDTHLHTPMYFLLSQLSLIDLNYISTIVPKMASDFLSGNKSISFTGCGIQSFFFSALGGAEALLLASMAYDRYIAICFPLHYPIRMSKRMCVLMITGSWIIGSINACAHTVYVLHIPYCQSRAINHFFCDVPAMVTLACMDTWVYEGTVFLSTTIFLVFPFIAISCSYGRVLLAVYHMKSAEGRKKAYLTCSTHLTVVTFYYAPFVYTYLRPRSLRSPTEDKVLAVFYTTLTPMLNPIIYSLRNKEVMGALTRVSQRICSGKM

SEQ ID NO: 59726 - protein, 312 aa, Homo sapiens
  Payload ID: 11744
  Gene Symbol: OR2L5
  Gene Name: olfactory receptor, family 2, subfamily L, member 5
  Uniprot ID: Q8NG80
  ENSP ID: ENSP00000347428
MENYNQTSTDFILLGLFPPSKIGLFLFILFVLIFLMALIGNLSMILLIFLDTHLHTPMYFLLSQLSLIDLNYISTIVPKMASDFLYGNKSISFIGCGIQSFFFMTFAGAEALLLTSMAYDRYVAICFPLHYPIRMSKRMYVLMITGSWMIGSINSCAHTVYAFRIPYCKSRAINHFFCDVPAMLTLACTDTWVYEYTVFLSSTIFLVFPFTGIACSYGWVLLAVYRMHSAEGRKKAYSTCSTHLTVVTFYYAPFAYTYLCPRSLRSLTEDKVLAVFYTILTPMLNPIIYSLRNKEVMGALTRVIQNIFSVKM

SEQ ID NO: 59727 - protein, 312 aa, Homo sapiens
  Payload ID: 11745
  Gene Symbol: OR2L8
  Gene Name: olfactory receptor, family 2, subfamily L, member 8 (gene/pseudogene)
  Uniprot ID: Q8NGY9
  ENSP ID: ENSP00000349719
MENYNQTSTDFILLGLFPPSRIDLFFFILIVFIFLMALIGNLSMILLIFLDTHLHTPMYFLLSQLSLIDLNYISTIVPKMASDFLHGNKSISFTGCGIQSFFFLALGGAEALLLASMAYDRYIAICFPLHYLIRMSKRVCVLMITGSWIIGSINACAHTVYVLHIPYCRSRAINHFFCDVPAMVTLACMDTWVYEGTVFLSATIFLVFPFIGISCSYGQVLFAVYHMKSAEGRKKAYLTCSTHLTVVTFYYAPFVYTYLRPRSLRSPTEDKVLAVFYTILTPMLNPIIYSLRNKEVMGALTRVSQRICSVKM

SEQ ID NO: 59728 - protein, 347 aa, Homo sapiens
  Payload ID: 11746
  Gene Symbol: OR2M2
  Gene Name: olfactory receptor, family 2, subfamily M, member 2
  Uniprot ID: Q96R28
  ENSP ID: ENSP00000352710
MAWENQTFNSDFILLGIFNHSPPHTFLFFLVLGIFLVAFMGNSVMVLLIYLDTQLHTPMYFLLSQLSLMDLMLICTTVPKMAFNYLSGSKSISMAGCVTQIFFYISLSGSECFLLAVMAYDRYIAICHPLRYTNLMNPKICGLMATFSWILGSTDGIIDAVATFSFSFCGSREIAHFFCEFPSLLILSCNDTSIFEEVIFICCIVMLVFPVAIIIASYARVILAVIHMGSGEGRCKAFTTCSSHLMVVGMYYGAALFMYIRPTSDHSPTQDKMVSVFYTILTPMLNPLIYSLRNKEVTRAFMKILGKGKSESELPHKLYVLLFAKFFFLISIFFYDVKILALIMYIA

SEQ ID NO: 59729 - protein, 312 aa, Homo sapiens
  Payload ID: 11747
  Gene Symbol: OR2M3
  Gene Name: olfactory receptor, family 2, subfamily M, member 3
  Uniprot ID: Q8NG83
  ENSP ID: ENSP00000389625
MARENSTFNSDFILLGIFNHSPTHTFLFFLVLAIFSVAFMGNSVMVLLIYLDTQLHTPMYLLLSQLSLMDLMLICTTVPKMAFNYLSGSKSISMAGCATQIFFYTSLLGSECFLLAVMAYDRYTAICHPLRYTNLMSPKICGLMTAFSWILGSTDGIIDVVATFSFSYCGSREIAHFFCDFPSLLILSCSDTSIFEKILFICCIVMIVFPVAIIIASYARVILAVIHMGSGEGRRKAFTTCSSHLLVVGMYYGAALFMYIRPTSDRSPTQDKMVSVFYTILTPMLNPLIYSLRNKEVTRAFMKILGKGKSGE

SEQ ID NO: 59730 - protein, 311 aa, Homo sapiens
  Payload ID: 11748
  Gene Symbol: OR2M4
  Gene Name: olfactory receptor, family 2, subfamily M, member 4
  Uniprot ID: Q96R27
  ENSP ID: ENSP00000306688
MVWENQTFNSIFILLGIFNHSPTHTFLFSLVLGIFSLALMENISMVLLIYIEKQLHTPMYFLLSQLSLMDLMLICTTLPKMIFSYLSGKKSISLAGCGTQIFFYVSLLGAECFLLAVMAYDRYVAICHPLQYTILMNPKLCVFMTVASWTLGSLDGIIVLAAVLSFSYCSSLEIHHFFCDVAALLPLSCTETSAFERLLVICCVVMLIFPVSVIILSYSHVLRAVIHMGSGESRRKAFTTCSSHLSVVGLYYGAAMFMYMRPASKHTPDQDKMVSAFYTILTPMLNPLIYSLRNKEVFRALQKVLKKRKLI

SEQ ID NO: 59731 - protein, 312 aa, Homo sapiens
  Payload ID: 11749
  Gene Symbol: OR2M5
  Gene Name: olfactory receptor, family 2, subfamily M, member 5
  Uniprot ID: A3KFT3
  ENSP ID: ENSP00000355432
MAWENQTFNSDFILLGIFNHSPTHTFLFFLVLAIFSVAFMGNSVMVLLIYLDTQLHTPMYFLLSQLFLMDLMLICSTVPKMAFNYLSGSKSISMAGCATQIFFYVSLLGSECFLLAVMSYDRYIAICHPLRYTNLMRPKICGLMTAFSWILGSMDAIIDAVATFSFSYCGSREIAHFFCDFPSLLILSCNDTSIFEKVLFICCIVMIVFPVAIIIASYARVILAVIHMGSGEGRRKAFTTCSSHLMVVGMYYGAGLFMYIRPTSDRSPMQDKLVSVFYTILTPMLNPLIYSLRNKEVTRALRKVLGKGKCGE

SEQ ID NO: 59732 - protein, 312 aa, Homo sapiens
  Payload ID: 11750
  Gene Symbol: OR2M7
  Gene Name: olfactory receptor, family 2, subfamily M, member 7
  Uniprot ID: Q8NG81
  ENSP ID: ENSP00000324557
MAWENQTFNSDFLLLGIFNHSPTHTFLFFLVLAIFSVAFMGNSIMVLLIYLDTQLHTPMYFLLSQLSLMDLMLICTTVPKMAFNYLSGSKSISMAGCATQIFFYISLLGSECFLLAVMSYDRYTAICHPLRYTNLMRPKICGLMTAFSWILGSTDGIIDAVATFSFSYCGSREIAHFCCDFPSLLILSCNDTSIFEEVIFICCIVMLVFPVAIIITSYARVILAVIHMGSGEGRRKAFTTCSSHLMVVGMYYGAGLFMCIQPTSHHSPMQDKMVSVFYTIVTPMLNPLIYSLRNKEVTRALMKILGKGKSGD

SEQ ID NO: 59733 - protein, 319 aa, Homo sapiens
  Payload ID: 11751
  Gene Symbol: OR2S2
  Gene Name: olfactory receptor, family 2, subfamily S, member 2 (gene/pseudogene)
  Uniprot ID: Q9NQN1
  ENSP ID: ENSP00000344040
MEKANETSPVMGFVLLRLSAHPELEKTFFVLILLMYLVILLGNGVLILVTILDSRLHTPMYFFLGNLSFLDICFTTSSVPLVLDSFLTPQETISFSACAVQMALSFAMAGTECLLLSMMAFDRYVAICNPLRYSVIMSKAAYMPMAASSWAIGGAASVVHTSLAIQLPFCGDNVINHFTCEILAVLKLACADISINVISMEVTNVIFLGVPVLFISFSYVFIITTILRIPSAEGRKKVFSTCSAHLTVVIVFYGTLFFMYGKPKSKDSMGADKEDLSDKLIPLFYGVVTPMLNPIIYSLRNKDVKAAVRRLLRPKGFTQ

SEQ ID NO: 59734 - protein, 319 aa, Homo sapiens; identical to SEQ ID NO: 59733
  Payload ID: 11751
  Gene Symbol: OR2S2
  Gene Name: olfactory receptor, family 2, subfamily S, member 2 (gene/pseudogene)
  Uniprot ID: Q9NQN1
  ENSP ID: ENSP00000485066

SEQ ID NO: 59735 - protein, 319 aa, Homo sapiens; identical to SEQ ID NO: 59733
  Payload ID: 11751
  Gene Symbol: OR2S2
  Gene Name: olfactory receptor, family 2, subfamily S, member 2 (gene/pseudogene)
  Uniprot ID: Q9NQN1
  ENSP ID: ENSP00000485516

SEQ ID NO: 59736 - protein, 369 aa, Homo sapiens
  Payload ID: 11752
  Gene Symbol: OR2T1
  Gene Name: olfactory receptor, family 2, subfamily T, member 1
  Uniprot ID: O43869
  ENSP ID: ENSP00000355430
MWQEYYFLNVFFPLLKVCCLTINSHVVILLPWECYHLIWKILPYIGTTVGSMEEYNTSSTDFTFMGLFNRKETSGLIFAIISIIFFTALMANGVMIFLIQTDLRLHTPMYFLLSHLSLIDMMYISTIVPKMLVNYLLDQRTISFVGCTAQHFLYLTLVGAEFFLLGLMAYDRYVAICNPLRYPVLMSRRVCWMIIAGSWFGGSLDGFLLTPITMSFPFCNSREINHFFCEAPAVLKLACADTALYETVMYVCCVLMLLIPFSVVLASYARILTTVQCMSSVEGRKKAFATCSSHMTVVSLFYGAAMYTYMLPHSYHKPAQDKVLSVFYTILTPMLNPLIYSLRNKDVTGALKRALGRFKGPQRVSGGVF

SEQ ID NO: 59737 - protein, 369 aa, Homo sapiens; identical to SEQ ID NO: 59736
  Payload ID: 11752
  Gene Symbol: OR2T1
  Gene Name: olfactory receptor, family 2, subfamily T, member 1
  Uniprot ID: O43869
  ENSP ID: ENSP00000479603

SEQ ID NO: 59738 - protein, 369 aa, Homo sapiens; identical to SEQ ID NO: 59736
  Payload ID: 11752
  Gene Symbol: OR2T1
  Gene Name: olfactory receptor, family 2, subfamily T, member 1
  Uniprot ID: O43869
  ENSP ID: ENSP00000482752

SEQ ID NO: 59739 - protein, 312 aa, Homo sapiens
  Payload ID: 11753
  Gene Symbol: OR2T10
  Gene Name: olfactory receptor, family 2, subfamily T, member 10
  Uniprot ID: Q8NGZ9
  ENSP ID: ENSP00000329210
MRLANQTLGGDFFLLGIFSQISHPGRLCLLIFSIFLMAVSWNITLILLIHIDSSLHTPMYFFINQLSLIDLTYISVTVPKMLVNQLAKDKTISVLGCGTQMYFYLQLGGAECCLLAAMAYDRYVAICHPLRYSVLMSHRVCLLLASGCWFVGSVDGFMLTPIAMSFPFCRSHEIQHFFCEVPAVLKLSCSDTSLYKIFMYLCCVIMLLIPVTVISVSYYYIILTIHKMNSVEGRKKAFTTCSSHITVVSLFYGAAIYNYMLPSSYQTPEKDMMSSFFYTILTPVLNPIIYSFRNKDVTRALKKMLSVQKPPY

SEQ ID NO: 59740 - protein, 316 aa, Homo sapiens; identical to SEQ ID NO: 59430
  Payload ID: 11754
  Gene Symbol: OR2T11
  Gene Name: olfactory receptor, family 2, subfamily T, member 11 (gene/pseudogene)
  Uniprot ID: Q8NH01
  ENSP ID: ENSP00000328934

SEQ ID NO: 59741 - protein, 320 aa, Homo sapiens
  Payload ID: 11755
  Gene Symbol: OR2T12
  Gene Name: olfactory receptor, family 2, subfamily T, member 12
  Uniprot ID: Q8NG77
  ENSP ID: ENSP00000324583
MEMRNTTPDFILLGLFNHTRAHQVLFMMLLATVLTSLFSNALMILLIHWDHRLHRPMYFLLSQLSLMDMMLVSTTVPKMAADYLTGNKAISRAGCGVQIFFLPTLGGGECFLLAAMAYDRYAAVCHPLRYPTLMSWQLCLRMTMSSWLLGAADGLLQAVATLSFPYCGAHEIDHFFCEAPVLVRLACADTSVFENAMYICCVLMLLVPFSLILSSYGLILAAVLLMRSTEARKKAFATCSSHVAVVGLFYGAGIFTYMRPKSHRSTNHDKVVSAFYTMFTPLLNPLIYSVRNSEVKEALKRWLGTCVNLKHQQNEAHRSR

SEQ ID NO: 59742 - protein, 324 aa, Homo sapiens
  Payload ID: 11756
  Gene Symbol: OR2T2
  Gene Name: olfactory receptor, family 2, subfamily T, member 2
  Uniprot ID: Q6IF00
  ENSP ID: ENSP00000343062
MGMEGLLQNSTNFVLTGLITHPAFPGLLFAIVFSIFVVAITANLVMILLIHMDSRLHTPMYFLLSQLSIMDTIYICITVPKMLQDLLSKDKTISFLGCAVQIFLYLTLIGGEFFLLGLMAYDRYVAVCNPLRYPLLMNRRVCLFMVVGSWVGGSLDGFMLTPVTMSFPFCRSREINHFFCEIPAVLKLSCTDTSLYETLMYACCVLMLLIPLSVISVSYTHILLTVHRMNSAEGRRKAFATCSSHIMVVSVFYGAAFYTNVLPHSYHTPEKDKVVSAFYTILTPMLNPLIYSLRNKDVAAALRKVLGRCGSSQSIRVATVIRKG

SEQ ID NO: 59743 - protein, 324 aa, Homo sapiens; identical to SEQ ID NO: 59742
  Payload ID: 11756
  Gene Symbol: OR2T2
  Gene Name: olfactory receptor, family 2, subfamily T, member 2
  Uniprot ID: Q6IF00
  ENSP ID: ENSP00000481002

SEQ ID NO: 59744 - protein, 324 aa, Homo sapiens; identical to SEQ ID NO: 59742
  Payload ID: 11756
  Gene Symbol: OR2T2
  Gene Name: olfactory receptor, family 2, subfamily T, member 2
  Uniprot ID: Q6IF00
  ENSP ID: ENSP00000482837

SEQ ID NO: 59745 - protein, 317 aa, Homo sapiens
  Payload ID: 11757
  Gene Symbol: OR2T27
  Gene Name: olfactory receptor, family 2, subfamily T, member 27
  Uniprot ID: Q8NH04
  ENSP ID: ENSP00000342008
MEQSNYSVYADFILLGLFSNARFPWLLFALILLVFLTSIASNVVKIILIHIDSRLHTPMYFLLSQLSLRDILYISTIVPKMLVDQVMSQRAISFAGCTAQHFLYLTLAGAEFFLLGLMSYDRYVAICNPLHYPVLMSRKICWLIVAAAWLGGSIDGFLLTPVTMQFPFCASREINHFFCEVPALLKLSCTDTSAYETAMYVCCIMMLLIPFSVISGSYTRILITVYRMSEAEGRGKAVATCSSHMVVVSLFYGAAMYTYVLPHSYHTPEQDKAVSAFYTILTPMLNPLIYSLRNKDVTGALQKVVGRCVSSGKVTTF

SEQ ID NO: 59746 - protein, 315 aa, Homo sapiens
  Payload ID: 11758
  Gene Symbol: OR2T29
  Gene Name: olfactory receptor, family 2, subfamily T, member 29
  Uniprot ID: Q8NH02
  ENSP ID: ENSP00000331774
MANITRMANHTGRLDFILMGLFRQSKHPALLSVVIFVVFLKALSGNAVLILLIHCDAHLHSPMYFFISQLSLMDMAYISVTVPKMLLDQVMGVNKVSAPECGMQMFLYLTLAGSEFFLLATMAYDRYVAICHPLRYPVLMNHRVCLFLASGCWFLGSVDGFMLTPITMSFPFCRSWEIHHFFCEVPAVTILSCSDTSLYETLMYLCCVLMLLIPVTIISSSYLLILLTVHRMNSAEGRKKAFATCSSHLTVVILFYGAAVYTYMLPSSYHTPEKDMMVSVFYTILTPVLNPLIYSLRNKDVMGALKKMLTVRFVL

SEQ ID NO: 59747 - protein, 318 aa, Homo sapiens
  Payload ID: 11759
  Gene Symbol: OR2T3
  Gene Name: olfactory receptor, family 2, subfamily T, member 3
  Uniprot ID: Q8NH03
  ENSP ID: ENSP00000352604
MCSGNQTSQNQTASTDFTLTGLFAESKHAALLYTVTFLLFLMALTGNALLILLIHSEPRLHTPMYFFISQLALMDLMYLCVTVPKMLVGQVTGDDTISPSGCGIQMFFYLTLAGAEVFLLAAMAYDRYAAVCRPLHYPLLMNQRVCQLLVSACWVLGMVDGLLLTPITMSFPFCQSRKILSFFCETPALLKLSCSDVSLYKTLMYLCCILMLLAPIMVISSSYTLILHLIHRMNSAAGHRKALATCSSHMIIVLLLFGASFYTYMLPSSYHTAEQDMMVSAFYTIFTPVLNPLIYSLRNKDVTRALRSMMQSRMNQEK

SEQ ID NO: 59748 - protein, 318 aa, Homo sapiens; identical to SEQ ID NO: 59747
  Payload ID: 11759
  Gene Symbol: OR2T3
  Gene Name: olfactory receptor, family 2, subfamily T, member 3
  Uniprot ID: Q8NH03
  ENSP ID: ENSP00000478611

SEQ ID NO: 59749 - protein, 318 aa, Homo sapiens; identical to SEQ ID NO: 59747
  Payload ID: 11759
  Gene Symbol: OR2T3
  Gene Name: olfactory receptor, family 2, subfamily T, member 3
  Uniprot ID: Q8NH03
  ENSP ID: ENSP00000480124

SEQ ID NO: 59750 - protein, 320 aa, Homo sapiens
  Payload ID: 11760
  Gene Symbol: OR2T33
  Gene Name: olfactory receptor, family 2, subfamily T, member 33
  Uniprot ID: Q8NG76
  ENSP ID: ENSP00000324687
MEMRNTTPDFILLGLFNHTRAHQVLFMMVLSIVLTSLFGNSLMILLIHWDHRLHTPMYFLLSQLSLMDMMLVSTTVPKMAADYLTGSKAISRAGCGVQIFFLPTLGGGECFLLAAMAYDRYAAVCHPLRYPTLMSWQLCLRMTMSCWLLGAADGLLQAVVTLSFPYCGAHEIDHFFCETPVLVRLACADTSVFENAMYICCVLMLLVPFSLILSSYGLILAAVLHMRSTEARKKAFATCSSHVAVVGLFYGAAIFTYMRPKSHRSTNHDKVVSAFYTMFTPLLNPLIYSVKNSEVKGALKRWLGTCVNIKHQQNEAHRSR

SEQ ID NO: 59751 - protein, 318 aa, Homo sapiens
  Payload ID: 11761
  Gene Symbol: OR2T34
  Gene Name: olfactory receptor, family 2, subfamily T, member 34
  Uniprot ID: Q8NGX1
  ENSP ID: ENSP00000330904
MCSGNQTSQNQTASTDFTLTGLFAESKHAALLYTVTFLLFLMALTGNALLILLIHSEPRLHTPMYFFISQLALMDLMYLCVTVPKMLVGQVTGDDTISPSGCGIQMFFHLTLAGAEVFLLAAMAYDRYAAVCRPLHYPLLMNQRVCQLLVSACWVLGMVDGLLLTPITMSFPFCQSRKILSFFCETPALLKLSCSDVSLYKMLTYLCCILMLLTPIMVISSSYTLILHLIHRMNSAAGRRKALATCSSHMIIVLLLFGASFYTYMLRSSYHTAEQDMMVSAFYTIFTPVLNPLIYSLRNKDVTRALRSMMQSRMNQEK

SEQ ID NO: 59752 - protein, 323 aa, Homo sapiens
  Payload ID: 11762
  Gene Symbol: OR2T35
  Gene Name: olfactory receptor, family 2, subfamily T, member 35
  Uniprot ID: Q8NGX2
  ENSP ID: ENSP00000324369
MGMEGLLQNSTNFVLTGLITHPAFPGLLFAVVFSIFVVAITANLVMILLIHMDSRLHTPMYFLLSQLSIMDTIYICITVPKMLQDLLSKDKTISFLGCAVQIFYLTLIGGEFFLLGLMAYDRYVAVCNPLRYPLLMNRRVCLFMVVGSWVGGSLDGFMLTPVTMSFPFCRSREINHFFCEIPAVLKLSCTDTSLYETLMYACCVLMLLIPLSVISVSYTHILLTVHRMNSAEGRRKAFATCSSHIMVVSVFYGAAFYTNVLPHSYHTPEKDKVVSAFYTILTPMLNPLIYSLRNKDVAAALRKVLGRCGSSQSIRVATVIRKG

SEQ ID NO: 59753 - protein, 348 aa, Homo sapiens
  Payload ID: 11763
  Gene Symbol: OR2T4
  Gene Name: olfactory receptor, family 2, subfamily T, member 4
  Uniprot ID: Q8NH00
  ENSP ID: ENSP00000355431
MDNITWMASHTGWSDFILMGLFRQSKHPMANITWMANHTGWSDFILLGLFRQSKHPALLCVVIFVVFLMALSGNAVLILLIHCDAHLHTPMYFFISQLSLMDMAYISVTVPKMLLDQVMGVNKISAPECGMQMFFYVTLAGSEFFLLATMAYDRYVAICHPLRYPVLMNHRVCLFLSSGCWFLGSVDGFTFTPITMTFPFRGSREIHHFFCEVPAVLNLSCSDTSLYEIFMYLCCVLMLLIPVVIISSSYLLILLTIHGMNSAEGRKKAFATCSSHLTVVILFYGAAIYTYMLPSSYHTPEKDMMVSVFYTILTPVVNPLIYSLRNKDVMGALKKMLTVEPAFQKAME

SEQ ID NO: 59754 - protein, 348 aa, Homo sapiens; identical to SEQ ID NO: 59753
  Payload ID: 11763
  Gene Symbol: OR2T4
  Gene Name: olfactory receptor, family 2, subfamily T, member 4
  Uniprot ID: Q8NH00
  ENSP ID: ENSP00000478105

SEQ ID NO: 59755 - protein, 348 aa, Homo sapiens; identical to SEQ ID NO: 59753
  Payload ID: 11763
  Gene Symbol: OR2T4
  Gene Name: olfactory receptor, family 2, subfamily T, member 4
  Uniprot ID: Q8NH00
  ENSP ID: ENSP00000484014

SEQ ID NO: 59756 - protein, 315 aa, Homo sapiens
  Payload ID: 11764
  Gene Symbol: OR2T5
  Gene Name: olfactory receptor, family 2, subfamily T, member 5
  Uniprot ID: Q6IEZ7
  ENSP ID: ENSP00000355429
MANITRMANHTGKLDFILMGLFRRSKHPALLSVVIFVVFLKALSGNAVLILLIHCDAHLHSPMYFFISQLSLMDMAYISVTVPKMLLDQVMGVNKVSAPECGMQMFLYLTLAGSEFFLLATMAYDRYVAICHPLRYPVLMNHRVCLFLASGCWFLGSVDGFMLTPITMSFPFCRSWEIHHFFCEVPAVTILSCSDTSLYETLMYLCCVLMLLIPVTIISSSYLLILLTVHRMNSAEGRKKAFATCSSHLTVVILFYGAAVYTYMLPSSYHTPEKDMMVSVFYTILTPVLNPLIYSLRNKDVMGALKKMLTVRFVL

SEQ ID NO: 59757 - protein, 315 aa, Homo sapiens; identical to SEQ ID NO: 59756
  Payload ID: 11764
  Gene Symbol: OR2T5
  Gene Name: olfactory receptor, family 2, subfamily T, member 5
  Uniprot ID: Q6IEZ7
  ENSP ID: ENSP00000480545

SEQ ID NO: 59758 - protein, 315 aa, Homo sapiens; identical to SEQ ID NO: 59756
  Payload ID: 11764
  Gene Symbol: OR2T5
  Gene Name: olfactory receptor, family 2, subfamily T, member 5
  Uniprot ID: Q6IEZ7
  ENSP ID: ENSP00000480714

SEQ ID NO: 59759 - protein, 308 aa, Homo sapiens
  Payload ID: 11765
  Gene Symbol: OR2T6
  Gene Name: olfactory receptor, family 2, subfamily T, member 6
  Uniprot ID: Q8NHC8
  ENSP ID: ENSP00000347965
MNENNETLTRGFTLMGLFTHNKCSGFFFGVICAVFFMAMIANGVMIFLINIDPHLHTPMYFLLSHLSVIDTLYISTIVPKMLVDYLMGEGTISFIACTAQCFLYMGFMGAEFFLLGLMAYDRYVAICNPLRYPVLISWRVCWMILASSWFGGALDSFLLTPITMSLPFCASHQINHFFCEAPTMLRLACGDKTTYETVMYVCCVAMLLIPFSVVTASYTRILITVHQMTSAEGRKKAFATCSSHMMVVTLFYGAALYTYTLPQSYHTPIKDKVFSAFYTILTPLLNPLIYSLRNRDVMGALKRVVARC

SEQ ID NO: 59760 - protein, 308 aa, Homo sapiens; identical to SEQ ID NO: 59759
  Payload ID: 11765
  Gene Symbol: OR2T6
  Gene Name: olfactory receptor, family 2, subfamily T, member 6
  Uniprot ID: Q8NHC8
  ENSP ID: ENSP00000478358

SEQ ID NO: 59761 - protein, 308 aa, Homo sapiens; identical to SEQ ID NO: 59759
  Payload ID: 11765
  Gene Symbol: OR2T6
  Gene Name: olfactory receptor, family 2, subfamily T, member 6
  Uniprot ID: Q8NHC8
  ENSP ID: ENSP00000481800

SEQ ID NO: 59762 - protein, 308 aa, Homo sapiens
  Payload ID: 11766
  Gene Symbol: OR2T7
  Gene Name: olfactory receptor, family 2, subfamily T, member 7
  Uniprot ID: P0C7T2
  ENSP ID: ENSP00000486110
MPTLSFWVCSATPVSPGFFALILLVFVTSIASNVVKIILIHIDSRLHTPMYFLLSQLSLRDILYISTIVPKMLVDQVMSQRAISFAGCTAQHFLYLTLAGAEFFLLGLMSCDRYVAICNPLHYPDLMSRKICWLIVAAAWLGGSIDGFLLTPVTMQFPFCASREINHFFCEVPALLKLSCTDTSAYETAMYVCCIMMLLIPFSVISGSYTRILITVYRMSEAEGRRKAVATCSSHMVVVSLFYGAAMYTYVLPHSYHTPEQDKAVSAFYTILTPMLNPLIYSLRNKDVTGALQKVVGRCVSSGKVTTF

SEQ ID NO: 59763 - protein, 308 aa, Homo sapiens; identical to SEQ ID NO: 59762
  Payload ID: 11766
  Gene Symbol: OR2T7
  Gene Name: olfactory receptor, family 2, subfamily T, member 7
  Uniprot ID: P0C7T2
  ENSP ID: ENSP00000486319

SEQ ID NO: 59764 - protein, 312 aa, Homo sapiens
  Payload ID: 11767
  Gene Symbol: OR2T8
  Gene Name: olfactory receptor, family 2, subfamily T, member 8
  Uniprot ID: A6NH00
  ENSP ID: ENSP00000326225
MENGSYTSYFILLGLFNHTRAHQVLFMMVLSIVLTSLFGNSLMILLIHWDHRLHTPMYFLLSQLSLMDVMLVSTTVPKMAADYLTGSKAISRAGCGAQIFFLPTLGGGECFLLAAMAYDRYAAVCHPLRYPTLMSWQLCLRMNLSCWLLGAADGLLQAVATLSFPYCGAHEIDHFFCETPVLVRLACADTSVFENAMYICCVLMLLVPFSLILSSYGLILAAVLHMRSTEARKKAFATCSSHVAVVGLFYGAAIFTYMRPKSHRSTNHDKVVSAFYTMFTPLLNPLIYSVKNSEVKGALTRCMGRCVALSRE

SEQ ID NO: 59765 - protein, 315 aa, Homo sapiens
  Payload ID: 11768
  Gene Symbol: OR2V1
  Gene Name: olfactory receptor, family 2, subfamily V, member 1
  Uniprot ID: Q8NHB1
  ENSP ID: ENSP00000404102
MGRWVNQSYTDGFFLLGIFSHSQTDLVLFSAVMVVFTVALCGNVLLIFLIYLDAGLHTPMYFFLSQLSLMDLMLVCNIVPKMAANFLSGRKSISFVGCGIQIGFFVSLVGSEGLLLGLMAYDRYVAVSHPLHYPILMNQRVCLQITGSSWAFGIIDGVIQMVAAMGLPYCGSRSVDHFFCEVQALLKLACADTSLFDTLLFACCVFMLLLPFSIIMASYACILGAVLRIRSAQAWKKALATCSSHLTAVTLFYGAAMFMYLRPRRYRAPSHDKVASIFYTVLTPMLNPLIYSLRNGEVMGALRKGLDRCRIGSQH

SEQ ID NO: 59766 - protein, 315 aa, Homo sapiens
  Payload ID: 11769
  Gene Symbol: OR2V2
  Gene Name: olfactory receptor, family 2, subfamily V, member 2
  Uniprot ID: Q96R30
  ENSP ID: ENSP00000332185
METWVNQSYTDGFFLLGIFSHSTADLVLFSVVMAVFTVALCGNVLLIFLIYMDPHLHTPMYFFLSQLSLMDLMLVCTNVPKMAANFLSGRKSISFVGCGIQIGLFVCLVGSEGLLLGLMAYDRYVAISHPLHYPILMNQRVCLQITGSSWAFGIIDGLIQMVVVMNFPYCGLRKVNHFFCEMLSLLKLACVDTSLFEKVIFACCVFMLLFPFSIIVASYAHILGTVLQMHSAQAWKKALATCSSHLTAVTLFYGAAMFIYLRPRHYRAPSHDKVASIFYTVLTPMLNPLIYSLRNREVMGALRKGLDRCRIGSQH

SEQ ID NO: 59767 - protein, 320 aa, Homo sapiens
  Payload ID: 11770
  Gene Symbol: OR2W1
  Gene Name: olfactory receptor, family 2, subfamily W, member 1
  Uniprot ID: Q9Y3N9
  ENSP ID: ENSP00000366380
MDQSNYSSLHGFILLGFSNHPKMEMILSGVVAIFYLITLVGNTAIILASLLDSQLHTPMYFFLRNLSFLDLCFTTSIIPQMLVNLWGPDKTISYVGCIIQLYVYMWLGSVECLLLAVMSYDRFTAICKPLHYFVVMNPHLCLKMIIMIWSISLANSVVLCTLTLNLPTCGNNILDHFLCELPALVKIACVDTTTVEMSVFALGIIIVLTPLILILISYGYIAKAVLRTKSKASQRKAMNTCGSHLTVVSMFYGTIIYMYLQPGNRASKDQGKFLTLFYTVITPSLNPLIYTLRNKDMKDALKKLMRFHHKSTKIKRNCKS

SEQ ID NO: 59768 - protein, 320 aa, Homo sapiens; identical to SEQ ID NO: 59767
  Payload ID: 11770
  Gene Symbol: OR2W1
  Gene Name: olfactory receptor, family 2, subfamily W, member 1
  Uniprot ID: Q9Y3N9
  ENSP ID: ENSP00000373150

SEQ ID NO: 59769 - protein, 320 aa, Homo sapiens; identical to SEQ ID NO: 59767
  Payload ID: 11770
  Gene Symbol: OR2W1
  Gene Name: olfactory receptor, family 2, subfamily W, member 1
  Uniprot ID: Q9Y3N9
  ENSP ID: ENSP00000388144

SEQ ID NO: 59770 - protein, 320 aa, Homo sapiens; identical to SEQ ID NO: 59767
  Payload ID: 11770
  Gene Symbol: OR2W1
  Gene Name: olfactory receptor, family 2, subfamily W, member 1
  Uniprot ID: Q9Y3N9
  ENSP ID: ENSP00000389825

SEQ ID NO: 59771 - protein, 320 aa, Homo sapiens; identical to SEQ ID NO: 59767
  Payload ID: 11770
  Gene Symbol: OR2W1
  Gene Name: olfactory receptor, family 2, subfamily W, member 1
  Uniprot ID: Q9Y3N9
  ENSP ID: ENSP00000392635

SEQ ID NO: 59772 - protein, 320 aa, Homo sapiens; identical to SEQ ID NO: 59767
  Payload ID: 11770
  Gene Symbol: OR2W1
  Gene Name: olfactory receptor, family 2, subfamily W, member 1
  Uniprot ID: Q9Y3N9
  ENSP ID: ENSP00000401866

SEQ ID NO: 59773 - protein, 320 aa, Homo sapiens; identical to SEQ ID NO: 59767
  Payload ID: 11770
  Gene Symbol: OR2W1
  Gene Name: olfactory receptor, family 2, subfamily W, member 1
  Uniprot ID: Q9Y3N9
  ENSP ID: ENSP00000405025

SEQ ID NO: 59774 - protein, 320 aa, Homo sapiens; identical to SEQ ID NO: 59767
  Payload ID: 11770
  Gene Symbol: OR2W1
  Gene Name: olfactory receptor, family 2, subfamily W, member 1
  Uniprot ID: Q9Y3N9
  ENSP ID: ENSP00000412537

SEQ ID NO: 59775 - protein, 314 aa, Homo sapiens
  Payload ID: 11771
  Gene Symbol: OR2W3
  Gene Name: olfactory receptor, family 2, subfamily W, member 3
  Uniprot ID: Q7Z3T1
  ENSP ID: ENSP00000353516
MDGTNGSTQTHFILLGFSDRPHLERILFVVILIAYLLTLVGNTTIILVSRLDPHLHTPMYFFLAHLSFLDLSFTTSSIPQLLYNLNGCDKTISYMGCAIQLFLFLGLGGVECLLLAVMAYDRCVAICKPLHYMVIMNPRLCRGLVSVTWGCGVANSLAMSPVTLRLPRCGHHEVDHFLREMPALIRMACVSTVAIEGTVFVLAVGVVLSPLVFILLSYSYIVRAVLQIRSASGRQKAFGTCGSHLTVVSLFYGNIIYMYMQPGASSSQDQGMFLMLFYNIVTPLLNPLIYTLRNREVKGALGRLLLGKRELGKE

SEQ ID NO: 59776 - protein, 311 aa, Homo sapiens
  Payload ID: 11772
  Gene Symbol: OR2Y1
  Gene Name: olfactory receptor, family 2, subfamily Y, member 1
  Uniprot ID: Q8NGV0
  ENSP ID: ENSP00000312403
MGSFNTSFEDGFILVGFSDWPQLEPILFVFIFIFYSLTLFGNTIIIALSWLDLRLHTPMYFFLSHLSLLDLCFTTSTVPQLLINLCGVDRTITRGGCVAQLFIYLALGSTECVLLVVMAFDRYAAVCRPLHYMAIMHPHLCQTLAIASWGAGFVNSLIQTGLAMAMPLCGHRLNHFFCEMPVFLKLACADTEGTEAKMFVARVIVVAVPAALILGSYVHIAHAVLRVKSTAGRRKAFGTCGSHLLVVFLFYGSAIYTYLQSIHNYSEREGKFVALFYTIITPILNPLIYTLRNKDVKGALWKVLWRGRDSG

SEQ ID NO: 59777 - protein, 314 aa, Homo sapiens
  Payload ID: 11773
  Gene Symbol: OR2Z1
  Gene Name: olfactory receptor, family 2, subfamily Z, member 1
  Uniprot ID: Q8NG97
  ENSP ID: ENSP00000316284
MGDVNQSVASDFILVGLFSHSGSRQLLFSLVAVMFVIGLLGNTVLLFLIRVDSRLHTPMYFLLSQLSLFDIGCPMVTIPKMASDFLRGEGATSYGGGAAQIFFLTLMGVAEGVLLVLMSYDRYVAVCQPLQYPVLMRRQVCLLMMGSSWVVGVLNASIQTSITLHFPYCASRIVDHFFCEVPALLKLSCADTCAYEMALSTSGVLILMLPLSLIATSYGHVLQAVLSMRSEEARHKAVTTCSSHITVVGLFYGAAVFMYMVPCAYHSPQQDNVVSLFYSLVTPTLNPLIYSLRNPEVWMALVKVLSRAGLRQMC

SEQ ID NO: 59778 - protein, 315 aa, Homo sapiens
  Payload ID: 11774
  Gene Symbol: OR3A1
  Gene Name: olfactory receptor, family 3, subfamily A, member 1
  Uniprot ID: P47881
  ENSP ID: ENSP00000313803
MQPESGANGTVIAEFILLGLLEAPGLQPVVFVLFLFAYLVTVRGNLSILAAVLVEPKLHTPMYFFLGNLSVLDVGCISVTVPSMLSRLLSRKRAVPCGACLTQLFFFHLFVGVDCFLLTAMAYDRFLAICRPLTYSTRMSQTVQRMLVAASWACAFTNALTHTVAMSTLNFCGPNVINHFYCDLPQLFQLSCSSTQLNELLLFAVGFIMAGTPMALIVISYIHVAAAVLRIRSVEGRKKAFSTCGSHLTVVAIFYGSGIFNYMRLGSTKLSDKDKAVGIFNTVINPMLNPIIYSFRNPDVQSAIWRMLTGRRSLA

SEQ ID NO: 59779 - protein, 321 aa, Homo sapiens
  Payload ID: 11774
  Gene Symbol: OR3A1
  Gene Name: olfactory receptor, family 3, subfamily A, member 1
  ENSP ID: ENSP00000484269
VSLQELMQPESGANGTVIAEFILLGLLEAPGLQPVVFVLFLFAYLVTVRGNLSILAAVLVEPKLHTPMYFFLGNLSVLDVGCISVTVPSMLSRLLSRKRAVPCGACLTQLFFFHLFVGVDCFLLTAMAYDRFLAICRPLTYSTRMSQTVQRMLVAASWACAFTNALTHTVAMSTLNFCGPNVINHFYCDLPQLFQLSCSSTQLNELLLFAVGFIMAGTPMALIVISYIHVAAAVLRIRSVEGRKKAFSTCGSHLTVVAIFYGSGIFNYMRLGSTKLSDKDKAVGIFNTVINPMLNPIIYSFRNPDVQSAIWRMLTGRRSLA

SEQ ID NO: 59780 - protein, 321 aa, Homo sapiens
  Payload ID: 11775
  Gene Symbol: OR3A2
  Gene Name: olfactory receptor, family 3, subfamily A, member 2
  Uniprot ID: P47893
  ENSP ID: ENSP00000386180
MSLQKLMEPEAGTNRTAVAEFILLGLVQTEEMQPVVFVLLLFAYLVTTGGNLSILAAVLVEPKLHAPMYFFLGNLSVLDVGCITVTVPAMLGRLLSHKSTISYDACLSQLFFFHLLAGMDCFLLTAMAYDRLLAICQPLTYSTRMSQTVQRMLVAASLACAFTNALTHTVAMSTLNFCGPNEVNHFYCDLPQLFQLSCSSTQLNELLLFAVGFIMAGTPLVLIITAYSHVAAAVLRIRSVEGRKKAFSTCGSHLTVVCLFFGRGIFNYMRLGSEEASDKDKGVGVFNTVINPMLNPLIYSLRNPDVQGALWQIFLGRRSLT

SEQ ID NO: 59781 - protein, 321 aa, Homo sapiens
  Payload ID: 11776
  Gene Symbol: OR3A3
  Gene Name: olfactory receptor, family 3, subfamily A, member 3
  Uniprot ID: P47888
  ENSP ID: ENSP00000291231
MSLQKLMEPEAGTNRTAVAEFILLGLVQTEEMQPVVFVLLLFAYLVTTGGNLSILAAVLVEPKLHAPMYFFLGNLSVLDVGCITVTVPAMLGRLLSHKSTISYDACLSQLFFFHLLAGMDCFLLTAMAYDRLLAICQPLTYSTRMSQTVQRMLVAASWACAFTNALTHTVAMSTLNFCGPNEVNHFYCDLPQLFQLSCSSTQLNELLLFVAAAFMAVAPLVFISVSYAHVVAAVLQIRSAEGRKKAFSTCGSHLTVVGIFYGTGVFSYMRLGSVESSDKDKGVGVFMTVINPMLNPLIYSLRNTDVQGALCQLLVGKRSLT

SEQ ID NO: 59782 - protein, 344 aa, Homo sapiens
  Payload ID: 11777
  Gene Symbol: OR4A15
  Gene Name: olfactory receptor, family 4, subfamily A, member 15
  Uniprot ID: Q8NGL6
  ENSP ID: ENSP00000325065
MELLTNNLKFITDPFVCRLRHLSPTPSEEHMKNKNNVTEFILLGLTQNPEGQKVLFVTFLLIYMVTIMGNLLIIVTIMASQSLGSPMYFFLASLSFIDTVYSTAFAPKMIVDLLSEKKTISFQGCMAQLFMDHLFAGAEVILLVVMAYDRYMAICKPLHELITMNRRVCVLMLLAAWIGGFLHSLVQFLFIYQLPFCGPNVIDNFLCDLYPLLKLACTNTYVTGLSMIANGGAICAVTFFTILLSYGVILHSLKTQSLEGKRKAFYTCASHVTVVILFFVPCIFLYARPNSTFPIDKSMTVVLTFITPMLNPLIYTLKNAEMKSAMRKLWSKKVSLAGKWLYHS

SEQ ID NO: 59783 - protein, 328 aa, Homo sapiens
  Payload ID: 11778
  Gene Symbol: OR4A16
  Gene Name: olfactory receptor, family 4, subfamily A, member 16
  Uniprot ID: Q8NH70
  ENSP ID: ENSP00000325128
MRPSSNVTEFVLLGLTQDPDVKKTLFVMFLLIYIVTMVGNLLIWVTTIGSPSLGSLMYFFLAYLSLMDAIYSTAMSPKLMIDLLCDKIAISLSACMGQLFIEHLLGGAEVFLLVVMAYDRYVAISKPLHYLNIMNRLVCILLLVVAMIGGFVHSVVQIVFLYSLPICGPNVIDHSVCDMYPLLELLCLDTYFIGLTVVANGGIICMVIFTFLLISCGVILNFLKTYSQEERHKALPTCISHIIVVALVFVPCIFMYVRPVSNFPFDKLMTVFYSIITLMLNPLIYSLRQSEMKNAMKNLWCEKLSIVRKRVSPTLNIFIPSSKATNRR

SEQ ID NO: 59784 - protein, 309 aa, Homo sapiens
  Payload ID: 11779
  Gene Symbol: OR4A47
  Gene Name: olfactory receptor, family 4, subfamily A, member 47
  Uniprot ID: Q6IF82
  ENSP ID: ENSP00000412752
MEPRKNVTDFVLLGFTQNPKEQKVLFVMFLLFYILTMVGNLLIVVTVTVSETLGSPMYFFLAGLSFIDIIYSSSISPRLISGLFFGNNSISFQSCMAQLFIEHIFGGSEVFLLLVMAYDCYVAICKPLHYLVIMRQWVCVVLLVVSWVGGFLHSVFQLSIIYGLPFCGPNVIDHFFCDMYPLLKLVCTDTHAIGLLVVANGGLACTIVFLLLLISYGVILHSLKNLSQKGRQKALSTCSSHMTVVVFFFVPCIFMYARPARTFPIDKSVSVFYTVITPMLNPLIYTLRNSEMTSAMKKLWRRDLISSST

SEQ ID NO: 59785 - protein, 315 aa, Homo sapiens
  Payload ID: 11780
  Gene Symbol: OR4A5
  Gene Name: olfactory receptor, family 4, subfamily A, member 5
  Uniprot ID: Q8NH83
  ENSP ID: ENSP00000367664
MRQNNNITEFVLLGFSQDPGVQKALFVMFLLTYLVTVVGNLLIVVDIIASPSLGSPMYFFLACLSFIDAAYSTTISPKLIVGLFCDKKTISFQGCMGQLFIDHFFGGAEVFLLVVMACDRYVAICKPLHYLTIMNRQVCFLLLVVAMIGGFVHSAFQIVVYSLPFCGPNVIVHFSCDMHPLLELACTDTYFIGLTVVVNSGAICMVIFNLLLISYGVILSSLKTYSQEKRGKALSTCSSGSTVVVLFFVPCIFIYVRPVSNFPTDKFMTVFYTIITHMLSPLIYTLRNSEMRNAIEKLLGKKLTIFIIGGVSVLM

SEQ ID NO: 59786 - protein, 314 aa, Homo sapiens
  Payload ID: 11781
  Gene Symbol: OR4A8
  Gene Name: olfactory receptor, family 4, subfamily A, member 8 (gene/pseudogene)
  ENSP ID: ENSP00000476467
MRQNNNITEFVLLGFSQYPDVQNALFVMFLLIYIVTMVGNLLIVVSIIASPFLGSPVYFFLACLSFIDAVYSTTISPVLIVDLLCDKKTISFPACMGQLFIEHLFGDTDVFLLVVMAYDRYVATCKPLRYLTIMNQVCILLLVVAVTGGFLHSVFQILVVYSLPFCGPNVIYHFFCNIYPLLDLECTDTYFVGLAVVFNGGAICMVIFTLLLISYGVILNSLKTYSPEGRHKAPFICSSHFIMVILFFVPCIFLYVRPVSNFPIDKFLTVFYSVITPKLNPFIYMLRNSEMRNAIENLLGYQSGKTGFRCSKLN

SEQ ID NO: 59787 - protein, 309 aa, Homo sapiens
  Payload ID: 11782
  Gene Symbol: OR4B1
  Gene Name: olfactory receptor, family 4, subfamily B, member 1
  Uniprot ID: Q8NGF8
  ENSP ID: ENSP00000311605
MASTSNVTELIFTGLFQDPAVQSVCFVVFLPVYLATVVGNGLIVLTVSISKSLDSPMYFFLSCLSLVEISYSSTIAPKFIIDLLAKIKTISLEGCLTQIFFFHFFGVAEILLIVVMAYDCYVAICKPLHYMNIISRQLCHLLVAGSWLGGFCHSIIQILVIIQLPFCGPNVIDHYFCDLQPLFKLACTDTFMEGVIVLANSGLFSVFSFLILVSSYIVILVNLRNHSAEGRHKALSTCASHITVVILFFGPAIFLYMRPSSTFTEDKLVAVFYTVITPMLNPIIYTLRNAEVKIAIRRLWSKKENPGRE

SEQ ID NO: 59788 - protein, 310 aa, Homo sapiens
  Payload ID: 11783
  Gene Symbol: OR4C11
  Gene Name: olfactory receptor, family 4, subfamily C, member 11
  Uniprot ID: Q6IEV9
  ENSP ID: ENSP00000306651
MQQNNSVPEFILLGLTQDPLRQKIVFVIFLIFYMGTVVGNMLIIVTIKSSRTLGSPMYFFLFYLSFADSCFSTSTAPRLIVDALSEKKIITYNECMTQVFALHLFGCMEIFVLILMAVDRYVAICKPLRYPTIMSQQVCIILIVLAWIGSLIHSTAQIILALRLPFCGPYLIDHYCCDLQPLLKLACMDTYMINLLLVSNSGAICSSSFMILIISYIVILHSLRNHSAKGKKKALSACTSHIIVVILFFGPCIFIYTRPPTTFPMDKMVAVFYTIGTPFLNPLIYTLRNAEVKNAMRKLWHGKIISENKG

SEQ ID NO: 59789 - protein, 309 aa, Homo sapiens
  Payload ID: 11784
  Gene Symbol: OR4C12
  Gene Name: olfactory receptor, family 4, subfamily C, member 12
  Uniprot ID: Q96R67
  ENSP ID: ENSP00000334418
MEKKKNVTEFILIGLTQNPIMEKVTFVVFLVLYMITLSGNLLIVVTITTSQALSSPMYFFLTHLSLIDTVYSSSSAPKLIVDSFQEKKIISFNGCMAQAYAEHIFGATEIILLTVMACDCYVAICKPLNYTTIMSHSLCILLVAVAWVGGFLHATIQILFTVWLPFCGPNVIGHFMCDLYPLLKLVCIDTHTLGLFVAVNSGFICLLNFLILVVSYVIILRSLKNNSLEGRCKALSTCISHIIVVVLFFVPCIFVYLRSVTTLPIDKAVAVFYTMVVPMLNPVVYTLRNAEVKSAIRKLWRKKVTSDND

SEQ ID NO: 59790 - protein, 309 aa, Homo sapiens
  Payload ID: 11785
  Gene Symbol: OR4C13
  Gene Name: olfactory receptor, family 4, subfamily C, member 13
  Uniprot ID: Q8NGP0
  ENSP ID: ENSP00000452277
MANRNNVTEFILLGLTENPKMQKIIFVVFSVIYINAMIGNVLIVVTITASPSLRSPMYFFLAYLSFIDACYSSVNTPKLITDSLYENKTILFNGCMTQVFGEHFFRGVEVILLTVMAYDHYVAICKPLHYTTVMKQHVCSLLVGVSWVGGFLHATIQILFICQLPFCGPNVIDHFMCDLYTLINLACTNTHTLGLFIAANSGFICLLNCLLLLVSCVVILYSLKTHSLEARHEALSTCVSHITVVILSFIPCIFVYMRPPATLPIDKAVAVFYTMITSMLNPLIYTLRNAQMKNAIRKLCSRKAISSVK

SEQ ID NO: 59791 - protein, 370 aa, Homo sapiens
  Payload ID: 11786
  Gene Symbol: OR4C15
  Gene Name: olfactory receptor, family 4, subfamily C, member 15
  Uniprot ID: Q8NGM1
  ENSP ID: ENSP00000324958
MFSMTTEALNNFALGCTNLLMTMIPQIDLKQIFLCPNCRLYMIPVGAFIFSLGNMQNQSFVTEFVLLGLSQNPNVQEIVFVVFLFVYIATVGGNMLIVVTILSSPALLVSPMYFFLGFLSFLDACFSSVITPKMIVDSLYVTKTISFEGCMMQLFAEHFFAGVEVIVLTAMAYDRYVAICKPLHYSSIMNRRLCGILMGVAWTGGLLHSMIQILFTFQLPFCGPNVINHFMCDLYPLLELACTDTHIFGLMVVINSGFICIINFSLLLVSYAVILLSLRTHSSEGRWKALSTCGSHIAVVILFFVPCIFVYTRPPSAFSLDKMAAIFYIILNPLLNPLIYTFRNKEVKQAMRRIWNRLMVVSDEKENIKL

SEQ ID NO: 59792 - protein, 310 aa, Homo sapiens; identical to SEQ ID NO: 59432
  Payload ID: 11787
  Gene Symbol: OR4C16
  Gene Name: olfactory receptor, family 4, subfamily C, member 16 (gene/pseudogene)
  Uniprot ID: Q8NGL9
  ENSP ID: ENSP00000324913

SEQ ID NO: 59793 - protein, 329 aa, Homo sapiens
  Payload ID: 11788
  Gene Symbol: OR4C3
  Gene Name: olfactory receptor, family 4, subfamily C, member 3
  Uniprot ID: Q8NH37
  ENSP ID: ENSP00000321419
MQLVLLLMFLLVFIGNTAPAFSVTLESMDIPQNITEFFMLGLSQNSEVQRVLFVVFLLIYVVTVCGNMLIVVTITSSPTLASPVYFFLANLSFIDTFYSSSMAPKLIADSLYEGRTISYECCMAQLFGAHFLGGVEIILLTVMAYDRYVAICKPLHNTTIMTRHLCAMLVGVAWLGGFLHSLVQLLLVLWLPFCGPNVINHFACDLYPLLEVACTNTYVIGLLVVANSGLICLLNFLMLAASYIVILYSLRSHSADGRCKALSTCGAHFIVVALFFVPCIFTYVHPFSTLPIDKNMALFYGILTPMLNPLIYTLRNEEVKNAMRKLFTW

SEQ ID NO: 59794 - protein, 199 aa, Homo sapiens [sequence omitted]

SEQ ID NO: 59795 - protein, 309 aa, Homo sapiens
  Payload ID: 11789
  Gene Symbol: OR4C46
  Gene Name: olfactory receptor, family 4, subfamily C, member 46
  Uniprot ID: A6NHA9
  ENSP ID: ENSP00000329056
MENRNNMTEFVLLGLTENPKMQKIIFVVFFVIYIITVVGYVLIVVTITASPSLGSPMYLSLAYLSFIDACYSSVNTPNLITHSLYGKKAILFNGCMTQVFGEHFFGGAEGILLTVMAYDHYVAICKPLHYMTIMNQCVCALLMGVVWMGGFLHATIQILFIFQLPFCGPNVIDHFMCDLNPLLNLACTDTHMLELFIAANSGFICLLNFALLLVSYVVILCSLRTHSLEARHKALSTCVSHITVVILFFVPCIFVYMRPAATLPIDKAVAIFYTMITPMLNPLIYTLKNAQMKNAIRKLCSRKDISGDK

SEQ ID NO: 59796 - protein, 326 aa, Homo sapiens
  Payload ID: 11790
  Gene Symbol: OR4C5
  Gene Name: olfactory receptor, family 4, subfamily C, member 5 (gene/pseudogene)
  Uniprot ID: Q8NGB2
  ENSP ID: ENSP00000321338
MYVSNCNPCAIHRKINYPNTKLDFEQVNNITEFILLGLTQNAEAQKLLFAVFTLIYFLTMVDNLIIVVTITTSPALDSPVYFFLSFFSFIDGCSSSTMAPKMIFDLLTEKKTISFSGCMTQLFVEHFFGGVEIILLVVMAYDCYVAICKPLYYLITMNRQVCGLLVAMAWVGGFLHALIQMLLIVWLPFCGPNVIDHFICDLFPLLKLSCTDTHVFGLFVAANSGLMCMLIFSILITSYVLILCSQRKALSTCAFHITVVVLFFVPCILVYLRPMITFPIDKAVSVFYTVVTPMLNPLIYTLRNTEVKNAMKQLWSQIIWGNNLCD

SEQ ID NO: 59797 - protein, 309 aa, Homo sapiens
  Payload ID: 11791
  Gene Symbol: OR4C6
  Gene Name: olfactory receptor, family 4, subfamily C, member 6
  Uniprot ID: Q8NH72
  ENSP ID: ENSP00000324769
MENQNNVTEFILLGLTENLELWKIFSAVFLVMYVATVLENLLIVVTIITSQSLRSPMYFFLTFLSLLDVMFSSVVAPKVIVDTLSKSTTISLKGCLTQLFVEHFFGGVGIILLTVMAYDRYVAICKPLHYTIIMSPRVCCLMVGGAWVGGFMHAMIQLLFMYQIPFCGPNIIDHFICDLFQLLTLACTDTHILGLLVTLNSGMMCVAIFLILIASYTVILCSLKSYSSKGRHKALSTCSSHLTVVVLFFVPCIFLYMRPVVTHPIDKAMAVSDSIITPMLNPLIYTLRNAEVKSAMKKLWMKWEALAGK

SEQ ID NO: 59798 - protein, 310 aa, Homo sapiens
  Payload ID: 11792
  Gene Symbol: OR4D1
  Gene Name: olfactory receptor, family 4, subfamily D, member 1
  Uniprot ID: Q15615
  ENSP ID: ENSP00000365451
MEPQNTTQVSMFVLLGFSQTQELQKFLFLLFLLVYVTTIVGNLLIMVTVTFDCRLHTPMYFLLRNLALIDLCYSTVTSPKMLVDFLHETKTISYQGCMAQIFFFHLLGGGTVFFLSVMAYDRYIAISQPLRYVTIMNTQLCVGLVVAAWVGGFVHSIVQLALILPLPFCGPNILDNFYCDVPQVLRLACTDTSLLEFLMISNSGLLVIIWFLLLLISYTVILVMLRSHSGKARRKAASTCTTHIIVVSMIFIPCIYIYTWPFTPFLMDKAVSISYTVMTPMLNPMIYTLRNQDMKAAMRRLGKCLVICRE

SEQ ID NO: 59799 - protein, 311 aa, Homo sapiens
  Payload ID: 11793
  Gene Symbol: OR4D10
  Gene Name: olfactory receptor, family 4, subfamily D, member 10
  Uniprot ID: Q8NGI6
  ENSP ID: ENSP00000436424
MEMENCTRVKEFIFLGLTQNREVSLVLFLFLLLVYVTTLLGNLLIMVTVTCESRLHTPMYFLLHNLSIADICFSSITVPKVLVDLLSERKTISFNHCFTQMFLFHLIGGVDVFSLSVMALDRYVAISKPLHYATIMSRDHCIGLTVAAWLGGFVHSIVQISLLLPLPFCGPNVLDTFYCDVHRVLKLAHTDIFILELLMISNNGLLTTLWFFLLLVSYIVILSLPKSQAGEGRRKAISTCTSHITVVTLHFVPCIYVYARPFTALPMDKAISVTFTVISPLLNPLIYTLRNHEMKSAMRRLKRRLVPSDRK

SEQ ID NO: 59800 - protein, 311 aa, Homo sapiens
  Payload ID: 11794
  Gene Symbol: OR4D11
  Gene Name: olfactory receptor, family 4, subfamily D, member 11
  Uniprot ID: Q8NGI4
  ENSP ID: ENSP00000320077
MELGNVTRVKEFIFLGLTQSQDQSLVLFLFLCLVYMTTLLGNLLIMVTVTCESRLHTPMYFLLRNLAILDICFSSTTAPKVLLDLLSKKKTISYTSCMTQIFLFHLLGGADIFSLSVMAFDCYMAISKPLHYVTIMSRGQCTALISASWMGGFVHSIVQISLLLPLPFCGPNVLDTFYCDVPQVLKLTCTDTFALEFLMISNNGLVTTLWFIFLLVSYTVILMTLRSQAGGGRRKAISTCTSHITVVTLHFVPCIYVYARPFTALPTEKAISVTFTVISPLLNPLIYTLRNQEMKSAMRRLKRRLVPSERE

SEQ ID NO: 59801 - protein, 307 aa, Homo sapiens
  Payload ID: 11795
  Gene Symbol: OR4D2
  Gene Name: olfactory receptor, family 4, subfamily D, member 2
  Uniprot ID: P58180
  ENSP ID: ENSP00000441354
METGNLTWVSDFVFLGLSQTRELQRFLFLMFLFVYITTVMGNILIIITVTSDSQLHTPMYFLLRNLAVLDLCFSSVTAPKMLVDLLSEKKTISYQGCMGQIFFFHFLGGAMVFFLSVMAFDRLIAISRPLRYVTVMNTQLWVGLVVATWVGGFVHSIVQLALMLPLPFCGPNILDNFYCDVPQVLRLACTDTSLLEFLKISNSGLLDVVWFFLLLMSYLFILVMLRSHPGEARRKAASTCTTHIIVVSMIFVPSIYLYARPFTPFPMDKLVSIGHTVMTPMLNPMIYTLRNQDMQAAVRRLGRHRLV

SEQ ID NO: 59802 - protein, 318 aa, Homo sapiens
  Payload ID: 11796
  Gene Symbol: OR4D5
  Gene Name: olfactory receptor, family 4, subfamily D, member 5
  Uniprot ID: Q8NGN0
  ENSP ID: ENSP00000305970
MNPANHSQVAGFVLLGLSQVWELRFVFFTVFSAVYFMTVVGNLLIVVIVTSDPHLHTTMYFLLGNLSFLDFCYSSITAPRMLVDLLSGNPTISFGGCLTQLFFFHFIGGIKIFLLTVMAYDRYIAISQPLHYTLIMNQTVCALLMAASWVGGFIHSIVQIALTIQLPFCGPDKLDNFYCDVPQLIKLACTDTFVLELLMVSNNGLVTLMCFLVLLGSYTALLVMLRSHSREGRSKALSTCASHIAVVTLIFVPCIYVYTRPFRTFPMDKAVSVLYTIVTPMLNPAIYTLRNKEVIMAMKKLWRRKKDPIGPLEHRPLH

SEQ ID NO: 59803 - protein, 314 aa, Homo sapiens
  Payload ID: 11797
  Gene Symbol: OR4D6
  Gene Name: olfactory receptor, family 4, subfamily D, member 6
  Uniprot ID: Q8NGJ1
  ENSP ID: ENSP00000300127
MDQINHTNVKEFFFLELTRSRELEFFLFVVFFAVYVATVLGNALIVVTITCESRLHTPMYFLLRNKSVLDIVFSSITVPKFLVDLLSDRKTISYNDCMAQIFFFHFAGGADIFFLSVMAYDRYLAIAKPLHYVTMMRKEVWVALVVASWVSGGLHSIIQVILMLPFPFCGPNTLDAFYCYVLQVVKLACTDTFALELFMISNNGLVTLLWFLLLLGSYTVILVMLRSHSGEGRNKALSTCTSHMLVVTLHFVPCVYIYCRPFMTLPMDTTISINNTVITPMLNPIIYSLRNQEMKSAMQRLQRRLGPSESRKWG

SEQ ID NO: 59804 - protein, 314 aa, Homo sapiens
  Payload ID: 11798
  Gene Symbol: OR4D9
  Gene Name: olfactory receptor, family 4, subfamily D, member 9
  Uniprot ID: Q8NGE8
  ENSP ID: ENSP00000328563
MDQRNYTRVKEFTFLGITQSRELSQVLFTFLFLVYMTTLMGNFLIMVTVTCESHLHTPMYFLLRNLSILDICFSSITAPKVLIDLLSETKTISFSGCVTQMFFFHLLGGADVFSLSVMAFDRYIAISKPLHYMTIMSRGRCTGLIVASWVGGFVHSIAQISLLLPLPFCGPNVLDTFYCDVPQVLKLACTDTFTLELLMISNNGLVSWFVFFFLLISYTVILMMLRSHTGEGRRKAISTCTSHITVVTLHFVPCIYVYARPFTALPTDTAISVTFTVISPLLNPIIYTLRNQEMKLAMRKLKRRLGQSERILIQ

SEQ ID NO: 59805 - protein, 313 aa, Homo sapiens
  Payload ID: 11799
  Gene Symbol: OR4E2
  Gene Name: olfactory receptor, family 4, subfamily E, member 2
  Uniprot ID: Q8NGC2
  ENSP ID: ENSP00000386195
MDSLNQTRVTEFVFLGLTDNRVLEMLFFMAFSAIYMLTLSGNILIIIATVFTPSLHTPMYFFLSNLSFIDICHSSVTVPKMLEGLLLERKTISFDNCITQLFFLHLFACAEIFLLIIMAYDRYVAICTPLHYPNVMNMRVCIQLVFALWLGGTVHSLGQTFLTIRLPYCGPNIIDSYFCDVPLVIKLACTDTYLTGILIVTNSGTISLSCFLAVVTSYMVILVSLRKHSAEGRRKALSTCSAHFMVVALFFGPCIFIYTRPDTSFSIDKVVSVFYTVVTPLLNPFIYTLRNEEVKSAMKQLRQRQVFFTKSYT

SEQ ID NO: 59806 - protein, 312 aa, Homo sapiens
  Payload ID: 11800
  Gene Symbol: OR4F15
  Gene Name: olfactory receptor, family 4, subfamily F, member 15
  Uniprot ID: Q8NGB8
  ENSP ID: ENSP00000333184
MNGMNHSVVSEFVFMGLTNSREIQLLLFVFSLLFYFASMMGNLVIVFTVTMDAHLHSPMYFLLANLSIIDMAFCSITAPKMICDIFKKHKAISFRGCITQIFFSHALGGTEMVLLIAMAFDRYMAICKPLHYLTIMSPRMCLYFLATSSIIGLIHSLVQLVFVVDLPFCGPNIFDSFYCDLPRLLRLACTNTQELEFMVTVNSGLISVGSFVLLVISYIFILFTVWKHSSGGLAKALSTLSAHVTVVILFFGPLMFFYTWPSPTSHLDKYLAIFDAFITPFLNPVIYTFRNKDMKVAMRRLCSRLAHFTKIL

SEQ ID NO: 59807 - protein, 309 aa, Homo sapiens
  Payload ID: 11800
  Gene Symbol: OR4F15
  Gene Name: olfactory receptor, family 4, subfamily F, member 15
  ENSP ID: ENSP00000481880
MDEANHSVVSEFVFLGLSDSRKIQLLLFLFFSVFYVSSLMGNLLIVLTVTSDPRLQSPMYFLLANLSIINLVFCSSTAPKMIYDLFRKHKTISFGGCVVQIFFIHAVGGTEMVLLIAMAFDRYVAICKPLHYLTIMSPRMCLYFLATSSIIGLIHSLVQLVFVVDLPFCGPNIFDSFYCDLPRLLRLACTNTQELEFMVTVNSGLISVGSFVLLVISYIFILFTVWKHSSGGLAKALSTLSAHVTVVILFFGPLMFFYTWPSPTSHLDKYLAIFDAFITPFLNPVIYTFRNKDMKVAMRRLCSRLAFYK

SEQ ID NO: 59808 - protein, 312 aa, Homo sapiens
  Payload ID: 11801
  Gene Symbol: OR4F16
  Gene Name: olfactory receptor, family 4, subfamily F, member 16
  Uniprot ID: Q6IEY1
  ENSP ID: ENSP00000329982
MDGENHSVVSEFLFLGLTHSWEIQLLLLVFSSVLYVASITGNILIVFSVTTDPHLHSPMYFLLASLSFIDLGACSVTSPKMIYDLFRKRKVISFGGCIAQIFFIHVVGGVEMVLLIAMAFDRYVALCKPLHYLTIMSPRMCLSFLAVAWTLGVSHSLFQLAFLVNLAFCGPNVLDSFYCDLPRLLRLACTDTYRLQFMVTVNSGFICVGTFFILLISYVFILFTVWKHSSGGSSKALSTLSAHSTVVLLFFGPPMFVYTRPHPNSQMDKFLAIFDAVLTPFLNPVVYTFRNKEMKAAIKRVCKQLVIYKRIS

SEQ ID NO: 59809 - protein, 305 aa, Homo sapiens
  Payload ID: 11802
  Gene Symbol: OR4F17
  Gene Name: olfactory receptor, family 4, subfamily F, member 17
  Uniprot ID: Q8NGA8
  ENSP ID: ENSP00000315047
MVTEFIFLGLSDSQGLQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVAWGIGFLHSVSQLAFAVHLPFCGPNEVDSFYCDLPRVIKLACTDTYRLDIMVIANSGVLTVCSFVLLIISYTIILMTIQHRPLDKSSKALSTLTAHITVVLLFFGPCVFIYAWPFPIKSLDKFLAVFYSVITPLLNPIIYTLRNKDMKTAIRQLRKWDAHSSVKF

SEQ ID NO: 59810 - protein, 305 aa, Homo sapiens; identical to SEQ ID NO: 59809
  Payload ID: 11802
  Gene Symbol: OR4F17
  Gene Name: olfactory receptor, family 4, subfamily F, member 17
  Uniprot ID: Q8NGA8
  ENSP ID: ENSP00000467301

SEQ ID NO: 59811 - protein, 312 aa, Homo sapiens
  Payload ID: 11803
  Gene Symbol: OR4F21
  Gene Name: olfactory receptor, family 4, subfamily F, member 21
  Uniprot ID: O95013
  ENSP ID: ENSP00000318878
MDGENHSVVSEFLFLGLTHSWEIQLLLLVFSSVLYVASITGNIFIVFSVTTDPHLHSPMYFLLASLSFIDLGACSVTSPKMIYDLFRKRKVISFGGCIAQIFFIHVIGGVEMVLLIAMAFDRYVALCKPLHYLTIMSPRMCLSFLAVAWTLGVSHSLFQLAFLVNLAFCGPNVLDSFYCDLPRLLRLACTDTYRLQFMVTVNSGFICVGTFFILLISYVFILFTVWKHSSGGSSKALSTLSAHSTVVLLFFGPPMFVYTRPHPNSQMDKFLAIFDAVLTPFLNPVVYTFRNKEMKAAIKRVCKQLVIYKKIS

SEQ ID NO: 59812 - protein, 312 aa, Homo sapiens; identical to SEQ ID NO: 59808
  Payload ID: 11804
  Gene Symbol: OR4F29
  Gene Name: olfactory receptor, family 4, subfamily F, member 29
  Uniprot ID: Q6IEY1
  ENSP ID: ENSP00000409316

SEQ ID NO: 59813 - protein, 312 aa, Homo sapiens; identical to SEQ ID NO: 59808
  Payload ID: 11805
  Gene Symbol: OR4F3
  Gene Name: olfactory receptor, family 4, subfamily F, member 3
  Uniprot ID: Q6IEY1
  ENSP ID: ENSP00000394282

SEQ ID NO: 59814 - protein, 305 aa, Homo sapiens
  Payload ID: 11806
  Gene Symbol: OR4F4
  Gene Name: olfactory receptor, family 4, subfamily F, member 4
  Uniprot ID: Q96R69
  ENSP ID: ENSP00000317482
MVTEFIFLGLSDSQELQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVAWGIGFLHSVSQLAFAVHLPFCGPNEVDSFYCDLPRVIKLACTDTYRLDIMVIANSGVLTVCSFVLLIISYTIILMTIQHCPLDKSSKALSTLTAHITVVLLFFGPCVFIYAWPFPIKSLDKFLAVFYSVITPLLNPIIYTLRNKDMKTAIRRLRKWDAHSSVKF

SEQ ID NO: 59815 - protein, 305 aa, Homo sapiens
  Payload ID: 11807
  Gene Symbol: OR4F5
  Gene Name: olfactory receptor, family 4, subfamily F, member 5
  Uniprot ID: Q8NH21
  ENSP ID: ENSP00000334393
MVTEFIFLGLSDSQELQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVTWGIGFLHSVSQLAFAVHLLFCGPNEVDSFYCDLPRVIKLACTDTYRLDIMVIANSGVLTVCSFVLLIISYTIILMTIQHRPLDKSSKALSTLTAHITVVLLFFGPCVFIYAWPFPIKSLDKFLAVFYSVITPLLNPIIYTLRNKDMKTAIRQLRKWDAHSSVKF

SEQ ID NO: 59816 - protein, 312 aa, Homo sapiens
  Payload ID: 11808
  Gene Symbol: OR4F6
  Gene Name: olfactory receptor, family 4, subfamily F, member 6
  Uniprot ID: Q8NGB9
  ENSP ID: ENSP00000327525
MDEANHSVVSEFVFLGLSDSRKIQLLLFLFFSVFYVSSLMGNLLIVLTVTSDPRLQSPMYFLLANLSIINLVFCSSTAPKMIYDLFRKHKTISFGGCVVQIFFIHAVGGTEMVLLIAMAFDRYVAICKPLHYLTIMNPQRCILFLVISWIIGIIHSVIQLAFVVDLLFCGPNELDSFFCDLPRFIKLACIETYTLGFMVTANSGFISLASFLILIISYIFILVTVQKKSSGGIFKAFSMLSAHVIVVVLVFGPLIFFYIFPFPTSHLDKFLAIFDAVITPVLNPVIYTFRNKEMMVAMRRRCSQFVNYSKIF

SEQ ID NO: 59817 - protein, 311 aa, Homo sapiens
  Payload ID: 11809
  Gene Symbol: OR4K1
  Gene Name: olfactory receptor, family 4, subfamily K, member 1
  Uniprot ID: Q8NGD4
  ENSP ID: ENSP00000285600
MAHTNESMVSEFVLLGLSNSWGLQLFFFAIFSIVYVTSVLGNVLIIVIISFDSHLNSPMYFLLSNLSFIDICQSNFATPKMLVDFFIERKTISFEGCMAQIFVLHSFVGSEMMLLVAMAYDRFIAICKPLHYSTIMNRRLCVIFVSISWAVGVLHSVSHLAFTVDLPFCGPNEVDSFFCDLPLVIELACMDTYEMEIMTLTNSGLISLSCFLALIISYTIILIGVRCRSSSGSSKALSTLTAHITVVILFFGPCIYFYIWPFSRLPVDKFLSVFYTVCTPLLNPIIYSLRNEDVKAAMWKLRNRHVNSWKN

SEQ ID NO: 59818 - protein, 304 aa, Homo sapiens
  Payload ID: 11810
  Gene Symbol: OR4K13
  Gene Name: olfactory receptor, family 4, subfamily K, member 13
  Uniprot ID: Q8NH42
  ENSP ID: ENSP00000319322
MERANHSVVSEFILLGLSKSQNLQILFFLGFSVVFVGIVLGNLLILVTVTFDSLLHTPMYFLLSNLSCIDMILASFATPKMIVDFLRERKTISWWGCYSQMFFMHLLGGSEMMLLVAMAIDRYVAICKPLHYMTIMSPRVLTGLLLSSYAVGFVHSSSQMAFMLTLPFCGPNVIDSFFCDLPLVIKLACKDTYILQLLVIADSGLLSLVCFLLLLVSYGVIIFSVRYRAASRSSKAFSTLSAHITVVTLFFAPCVFIYVWPFSRYSVDKILSVFYTIFTPLLNPIIYTLRNQEVKAAIKKRLCI

SEQ ID NO: 59819 - protein, 310 aa, Homo sapiens
  Payload ID: 11811
  Gene Symbol: OR4K14
  Gene Name: olfactory receptor, family 4, subfamily K, member 14
  Uniprot ID: Q8NGD5
  ENSP ID: ENSP00000305011
MDPQNYSLVSEFVLHGLCTSRHLQNFFFIFFFGVYVAIMLGNLLILVTVISDPCLHSSPMYFLLGNLAFLDMWLASFATPKMIRDFLSDQKLISFGGCMAQIFFLHFTGGAEMVLLVSMAYDRYVAICKPLHYMTLMSWQTCIRLVLASWVVGFVHSISQVAFTVNLPYCGPNEVDSFFCDLPLVIKLACMDTYVLGIIMISDSGLLSLSCFLLLLISYTVILLAIRQRAAGSTSKALSTCSAHIMVVTLFFGPCIFVYVRPFSRFSVDKLLSVFYTIFTPLLNPIIYTLRNEEMKAAMKKLQNRRVTFQ

SEQ ID NO: 59820 - protein, 348 aa, Homo sapiens
  Payload ID: 11812
  Gene Symbol: OR4K15
  Gene Name: olfactory receptor, family 4, subfamily K, member 15
  Uniprot ID: Q8NH41
  ENSP ID: ENSP00000304077
MLTSLTDLCFSPIQVAEIKSLPKSMNETNHSRVTEFVLLGLSSSRELQPFLFLTFSLLYLAILLGNFLIILTVTSDSRLHTPMYFLLANLSFIDVCVASFATPKMIADFLVERKTISFDACLAQIFFVHLFTGSEMVLLVSMAYDRYVAICKPLHYMTVMSRRVCVVLVLISWFVGFIHTTSQLAFTVNLPFCGPNKVDSFFCDLPLVTKLACIDTYVVSLLIVADSGFLSLSSFLLLVVSYTVILVTVRNRSSASMAKARSTLTAHITVVTLFFGPCIFIYVWPFSSYSVDKVLAVFYTIFTLILNPVIYTLRNKEVKAAMSKLKSRYLKPSQVSVVIRNVLFLETK

SEQ ID NO: 59821 - protein, 343 aa, Homo sapiens
  Payload ID: 11813
  Gene Symbol: OR4K17
  Gene Name: olfactory receptor, family 4, subfamily K, member 17
  Uniprot ID: Q8NGC6
  ENSP ID: ENSP00000319197
MALYFSLILHGMSDLFFLSTGHPRASCRMEAMKLLNQSQVSEFILLGLTSSQDVEFLLFALFSVIYVVTVLGNLLIIVTVFNTPNLNTPMYFLLGNLSFVDMTLASFATPKVILNLLKKQKVISFAGCFTQIFLLHLLGGVEMVLLVSMAFDRYVAICKPLHYMTIMNKKVCVLLVVTSWLLGLLHSGFQIPFAVNLPFCGPNVVDSIFCDLPLVTKLACIDIYFVQVVIVANSGIISLSCFIILLISYSLILITIKNHSPTGQSKARSTLTAHITVVILFFGPCIFIYIWPFGNHSVDKFLAVFYTIITPILNPIIYTLRNKEMKISMKKLWRAFVNSREDT

SEQ ID NO: 59822 - protein, 314 aa, Homo sapiens
  Payload ID: 11814
  Gene Symbol: OR4K2
  Gene Name: olfactory receptor, family 4, subfamily K, member 2
  Uniprot ID: Q8NGD2
  ENSP ID: ENSP00000298642
MDVGNKSTMSEFVLLGLSNSWELQMFFFMVFSLLYVATMVGNSLIVITVIVDPHLHSPMYFLLTNLSIIDMSLASFATPKMITDYLTGHKTISFDGCLTQIFFLHLFTGTEIILLMAMSFDRYIAICKPLHYASVISPQVCVALVVASWIMGVMHSMSQVIFALTLPFCGPYEVDSFFCDLPVVFQLACVDTYVLGLFMISTSGIIALSCFIVLFNSYVIVLVTVKHHSSRGSSKALSTCTAHFIVVFLFFGPCIFIYMWPLSSFLTDKILSVFYTIFTPTLNPIIYTLRNQEVKIAMRKLKNRFLNFNKAMPS

SEQ ID NO: 59823 - protein, 323 aa, Homo sapiens
  Payload ID: 11815
  Gene Symbol: OR4K5
  Gene Name: olfactory receptor, family 4, subfamily K, member 5
  Uniprot ID: Q8NGD3
  ENSP ID: ENSP00000319511
MDKSNSSVVSEFVLLGLCSSQKLQLFYFCFFSVLYTVIVLGNLLIILTVTSDTSLHSPMYFLLGNLSFVDICQASFATPKMIADFLSAHETISFSGCIAQIFFIHLFTGGEMVLLVSMAYDRYVAICKPLYYVVIMSRRTCTVLVMISWAVSLVHTLSQLSFTVNLPFCGPNVVDSFFCDLPRVTKLACLDSYIIEILIVVNSGILSLSTFSLLVSSYIIILVTVWLKSSAAMAKAFSTLASHIAVVILFFGPCIFIYVWPFTISPLDKFLAIFYTVFTPVLNPIIYTLRNRDMKAAVRKIVNHYLRPRRISEMSLVVRTSFH

SEQ ID NO: 59824 - protein, 312 aa, Homo sapiens
  Payload ID: 11816
  Gene Symbol: OR4L1
  Gene Name: olfactory receptor, family 4, subfamily L, member 1
  Uniprot ID: Q8NH43
  ENSP ID: ENSP00000319217
MDLKNGSLVTEFILLGFFGRWELQIFFFVTFSLIYGATVMGNILIMVTVTCRSTLHSPLYFLLGNLSFLDMCLSTATTPKMIIDLLTDHKTISVWGCVTQMFFMHFFGGAEMTLLIIMAFDRYVAICKPLHYRTIMSHKLLKGFAILSWIIGFLHSISQIVLTMNLPFCGHNVINNIFCDLPLVIKLACIETYTLELFVIADSGLLSFTCFILLLVSYIVILVSVPKKSSHGLSKALSTLSAHIIVVTLFFGPCIFIYVWPFSSLASNKTLAVFYTVITPLLNPSIYTLRNKKMQEAIRKLRFQYVSSAQNF

SEQ ID NO: 59825 - protein, 313 aa, Homo sapiens
  Payload ID: 11817
  Gene Symbol: OR4M1
  Gene Name: olfactory receptor, family 4, subfamily M, member 1
  Uniprot ID: Q8NGD0
  ENSP ID: ENSP00000319654
METANYTKVTEFVLTGLSQTREVQLVLFVIFLSFYLFILPGNILIICTIRLDPHLTSPMYFLLANLALLDIWYSSITAPKMLIDFFVERKIISFGGCIAQLFFLHFVGASEMFLLTVMAYDRYAAICRPLHYATIMNRRLCCILVALSWMGGFIHSIIQVALIVRLPFCGPNELDSYFCDITQVVRIACANTFPEELVMICSSGLISVVCFIALLMSYAFLLALLKKHSGSGENTNRAMSTCYSHITIVVLMFGPSIYIYARPFDSFSLDKVVSVFHTVIFPLLNPIIYTLRNKEVKAAMRKVVTKYILCEEK

SEQ ID NO: 59826 - protein, 313 aa, Homo sapiens
  Payload ID: 11818
  Gene Symbol: OR4M2
  Gene Name: olfactory receptor, family 4, subfamily M, member 2
  Uniprot ID: Q8NGB6
  ENSP ID: ENSP00000483239
METANYTKVTEFVLTGLSQTPEVQLVLFVIFLSFYLFILPGNILIICTISLDPHLTSPMYFLLANLAFLDIWYSSITAPEMLIDFFVERKIISFDGCIAQLFFLHFAGASEMFLLTVMAFDLYTAICRPLHYATIMNQRLCCILVALSWRGGFIHSIIQVALIVRLPFCGPNELDSYFCDITQVVRIACANTFPEELVMICSSGLISVVCLIALLMSYAFLLALFKKLSGSGENTNRAMSTCYSHITIVVLMFGPSIYIYARPFDSFSLDKVVSVFNTLIFPLRNPIIYTLRNKEVKAAMRKLVTKYILCKEK

SEQ ID NO: 59827 - protein, 307 aa, Homo sapiens
  Payload ID: 11819
  Gene Symbol: OR4N2
  Gene Name: olfactory receptor, family 4, subfamily N, member 2
  Uniprot ID: Q8NGD1
  ENSP ID: ENSP00000319601
MESENRTVIREFILLGLTQSQDIQLLVFVLVLIFYFIILPGNFLIIFTIKSDPGLTAPLYFFLGNLAFLDASYSFIVAPRMLVDFLSAKKIISYRGCITQLFFLHFLGGGEGLLLVVMAFDRYIAICRPLHYPTVMNPRTCYAMMLALWLGGFVHSIIQVVLILRLPFCGPNQLDNFFCDVPQVIKLACTDTFVVELLMVFNSGLMTLLCFLGLLASYAVILCRIRGSSSEAKNKAMSTCITHIIVIFFMFGPGIFIYTRPFRAFPADKVVSLFHTVIFPLLNPVIYTLRNQEVKASMKKVFNKHIA

SEQ ID NO: 59828 - protein, 21 aa, Homo sapiens
  Payload ID: 11819
  Gene Symbol: OR4N2
  Gene Name: olfactory receptor, family 4, subfamily N, member 2
  ENSP ID: ENSP00000451462
MESENRTVIREFILLGLTQSQ

SEQ ID NO: 59829 - protein, 146 aa, Homo sapiens
  Payload ID: 11819
  Gene Symbol: OR4N2
  Gene Name: olfactory receptor, family 4, subfamily N, member 2
  ENSP ID: ENSP00000452022
MESENRTVIREFILLGLTQSQDIQLLVFVLVLIFYFIILPGNFLIIFTIKSDPGLTAPLYFFLGNLAFLDASYSFIVAPRMLVDFLSAKKIISYRGCITQLFFLHFLGGGEGLLLVVMAFDRYIAICRPLHYPTVMNPRTCYAMML

SEQ ID NO: 59830 - protein, 316 aa, Homo sapiens
  Payload ID: 11820
  Gene Symbol: OR4N4
  Gene Name: olfactory receptor, family 4, subfamily N, member 4
  Uniprot ID: Q8N0Y3
  ENSP ID: ENSP00000332500
MKIANNTVVTEFILLGLTQSQDIQLLVFVLILIFYLIILPGNFLIIFTIRSDPGLTAPLYLFLGNLAFLDASYSFIVAPRMLVDFLSEKKVISYRGCITQLFFLHFLGGGEGLLLVVMAFDRYIAICRPLHCSTVMNPRACYAMMLALWLGGFVHSIIQVVLILRLPFCGPNQLDNFFCDVRQVIKLACTDMFVVELLMVFNSGLMTLLCFLGLLASYAVILCHVRRAASEGKNKAMSTCTTRVIIILLMFGPAIFIYMCPFRALPADKMVSLFHTVIFPLMNPMIYTLRNQEVKTSMKRLLSRHVVCQVDFIIRN

SEQ ID NO: 59831 - protein, 308 aa, Homo sapiens
  Payload ID: 11821
  Gene Symbol: OR4N5
  Gene Name: olfactory receptor, family 4, subfamily N, member 5
  Uniprot ID: Q8IXE1
  ENSP ID: ENSP00000332110
METQNLTVVTEFILLGLTQSQDAQLLVFVLVLIFYLIILPGNFLIIFTIKSDPGLTAPLYFFLGNLALLDASYSFIVVPRMLVDFLSEKKVISYRSCITQLFFLHFLGAGEMFLLVVMAFDRYIAICRPLHYSTIMNPRACYALSLVLWLGGFIHSIVQVALILHLPFCGPNQLDNFFCDVPQVIKLACTNTFVVELLMVSNSGLLSLLCFLGLLASYAVILCRIREHSSEGKSKAISTCTTHIIIIFLMFGPAIFIYTCPFQAFPADKVVSLFHTVIFPLMNPVIYTLRNQEVKASMRKLLSQHMFC

SEQ ID NO: 59832 - protein, 312 aa, Homo sapiens
  Payload ID: 11822
  Gene Symbol: OR4P4
  Gene Name: olfactory receptor, family 4, subfamily P, member 4
  Uniprot ID: Q8NGL7
  ENSP ID: ENSP00000324831
MEKSNNSTLFILLGFSQNKNIEVLCFVLFLFCYIAIWMGNLLIMISITCTQLIHQPMYFFLNYLSLSDLCYTSTVTPKLMVDLLAERKTISYNNCMIQLFTTHFFGGIEIFILTGMAYDRYVAICKPLHYTIIMSRQKCNTIIIVCCTGGFIHSASQFLLTIFVPFCGPNEIDHYFCDVYPLLKLACSNIHMIGLLVIANSGLIALVTFVVLLLSYVFILYTIRAYSAERRSKALATCSSHVIVVVLFFAPALFIYIRPVTTFSEDKVFALFYTIIAPMFNPLIYTLRNTEMKNAMRKVWCCQILLKRNQLF

SEQ ID NO: 59833 - protein, 310 aa, Homo sapiens
  Payload ID: 11823
  Gene Symbol: OR4Q2
  Gene Name: olfactory receptor, family 4, subfamily Q, member 2 (gene/pseudogene)
  ENSP ID: ENSP00000438013
MDKNQTEVMREFFLSGFSQTPSIEAGLFVLFLFFYMSIWVGNVLIMVTVASDKYLNSSPMYFLLGNLSFLDLCYSTVTTPKLLADFFNHEKLISYDQCIVQLFFLHFVGAAEMFLLTVMAYDRYVAICRPLHYTTVMSRGLCCVLVAASWMGGFVHSTVQTILTVHLPFCGPNQVENFFLCSPCHQTCLCHFCHIAHGIQWVDLHHLLCGADFLLHHYPSQDSLQGRKAKGTLHVCLSPHGGNTVFWTLYFHLRSSFLYIFCGQDGVCTLQCYYPNAKPPHLHTSEQRGKVSHAEALGQKWAYLEKAGDM

SEQ ID NO: 59834 - protein, 307 aa, Homo sapiens
  Payload ID: 11823
  Gene Symbol: OR4Q2
  Gene Name: olfactory receptor, family 4, subfamily Q, member 2 (gene/pseudogene)
  ENSP ID: ENSP00000484287
MDKNQTEVMREFFLSGFSQTPSIEAGLFVLFLFFYMSIWVGNVLIMVTVASDKYLNSSPMYFLLGNLSFLDLCYSTVTTPKLLADFFNHEKLISYDQCIVQLFFLHFVGAAEMFLLTVMAYDRYVAICRPLHYTTVMSRGLCCVLVAASWMGGFVHSTVQTILTVHLPFCGPNQVTFFCDVPPVIKLACADTFVIELLMVSNSGLISTISFVVLISSYTTILVKIRSKEGRRKALSTCASHLMVVTLFFGPCIFIYARPFSTFSVDKMVSVLYNVITPMLNPLIYTLRNKEVKSAMQKLWVKIITFQ

SEQ ID NO: 59835 - protein, 313 aa, Homo sapiens
  Payload ID: 11824
  Gene Symbol: OR4Q3
  Gene Name: olfactory receptor, family 4, subfamily Q, member 3
  Uniprot ID: Q8NH05
  ENSP ID: ENSP00000330049
MKKEQDSNVTEFVLLGLSSSWELQLFLFLLFLFFYIAIVLGNLLIVVTVQAHAHLLQSPMYYFLGHLSFIDLCLSCVTVPKMLGDFLQQGKSISFSGCLAQIYFLHFLGASEMFLLTVMAYDRYVAICNPLRYLTVMNPQLCLWLVLACWCGGFIHSIMQVILVIQLPFCGPNELDNFYCDVPQVIKLACMDTYVVEVLVIANSGLLSLVCFLVLLFSYAIILITLRTHFCQGQNKVFSTCASHLTVVSLIFVPCVFIYLRPFCSFSVDKIFSLFYTVITPMLNPLIYTLRNTDMKTAMKKLRIKPCGIPLPC

SEQ ID NO: 59836 - protein, 309 aa, Homo sapiens
  Payload ID: 11825
  Gene Symbol: OR4S1
  Gene Name: olfactory receptor, family 4, subfamily S, member 1
  Uniprot ID: Q8NGB4
  ENSP ID: ENSP00000321447
MGAKNNVTEFVLFGLFESREMQHTCFVVFFLFHVLTVLGNLLVIITINARKTLKSPMYFFLSQLSFADICYPSTTIPKMIADTFVEHKIISFNGCMTQLFSAHFFGGTEIFLLTAMAYDRYVAICRPLHYTAIMDCRKCGLLAGASWLAGFLHSILQTLLTVQLPFCGPNEIDNFFCDVHPLLKLACADTYMVGLIVVANSGMISLASFFILIISYVIILLNLRSQSSEDRRKAVSTCGSHVITVLLVLMPPMFMYIRPSTTLAADKLIILFNIVMPPLLNPLIYTLRNNDVKNAMRKLFRVKRSLGEK

SEQ ID NO: 59837 - protein, 311 aa, Homo sapiens
  Payload ID: 11826
  Gene Symbol: OR4S2
  Gene Name: olfactory receptor, family 4, subfamily S, member 2
  Uniprot ID: Q8NH73
  ENSP ID: ENSP00000310337
MEKINNVTEFIFWGLSQSPEIEKVCFVVFSFFYIIILLGNLLIMLTVCLSNLFKSPMYFFLSFLSFVDICYSSVTAPKMIVDLLAKDKTISYVGCMLQLFGVHFFGCTEIFILTVMAYDRYVAICKPLHYMTIMNRETCNKMLLGTWVGGFLHSIIQVALVVQLPFCGPNEIDHYFCDVHPVLKLACTETYIVGVVVTANSGTIALGSFVILLISYSIILVSLRKQSAEGRRKALSTCGSHIAMVVIFFGPCTFMYMRPDTTFSEDKMVAVFYTIITPMLNPLIYTLRNAEVKNAMKKLWGRNVFLEAKGK

SEQ ID NO: 59838 - protein, 305 aa, Homo sapiens
  Payload ID: 11827
  Gene Symbol: OR4X1
  Gene Name: olfactory receptor, family 4, subfamily X, member 1 (gene/pseudogene)
  Uniprot ID: Q8NH49
  ENSP ID: ENSP00000321506
MVATNNVTEIIFVGFSQNWSEQRVISVMFLLMYTAVVLGNGLIVVTILASKVLTSPMYFFLSYLSFVEICYCSVMAPKLIFDSFIKRKVISLKGCLTQMFSLHFFGGTEAFLLMVMAYDRYVAICKPLHYMAIMNQRMCGLLVRIAWGGGLLHSVGQTFLIFQLPFCGPNIMDHYFCDVHPVLELACADTFFISLLIITNGGSISVVSFFVLMASYLIILHFLRSHNLEGQHKALSTCASHVTVVDLFFIPCSLVYIRPCVTLPADKIVAVFYTVVTPLLNPVIYSFRNAEVKNAMRRFIGGKVI

SEQ ID NO: 59839 - protein, 305 aa, Homo sapiens; identical to SEQ ID NO: 59838
  Payload ID: 11827
  Gene Symbol: OR4X1
  Gene Name: olfactory receptor, family 4, subfamily X, member 1 (gene/pseudogene)
  Uniprot ID: Q8NH49
  ENSP ID: ENSP00000485255

SEQ ID NO: 59840 - protein, 305 aa, Homo sapiens; identical to SEQ ID NO: 59838
  Payload ID: 11827
  Gene Symbol: OR4X1
  Gene Name: olfactory receptor, family 4, subfamily X, member 1 (gene/pseudogene)
  Uniprot ID: Q8NH49
  ENSP ID: ENSP00000485503

SEQ ID NO: 59841 - protein, 303 aa, Homo sapiens; identical to SEQ ID NO: 59435
  Payload ID: 11828
  Gene Symbol: OR4X2
  Gene Name: olfactory receptor, family 4, subfamily X, member 2 (gene/pseudogene)
  Uniprot ID: Q8NGF9
  ENSP ID: ENSP00000485191

SEQ ID NO: 59842 - protein, 315 aa, Homo sapiens
  Payload ID: 11829
  Gene Symbol: OR5A1
  Gene Name: olfactory receptor, family 5, subfamily A, member 1
  Uniprot ID: Q8NGJ0
  ENSP ID: ENSP00000303096
MSITKAWNSSSVTMFILLGFTDHPELQALLFVTFLGIYLTTLAWNLALIFLIRGDTHLHTPMYFFLSNLSFIDICYSSAVAPNMLTDFFWEQKTISFVGCAAQFFFFVGMGLSECLLLTAMAYDRYAAISSPLLYPTIMTQGLCTRMVVGAYVGGFLSSLIQASSIFRLHFCGPNIINHFFCDLPPVLALSCSDTFLSQVVNFLVVVTVGGTSFLQLLISYGYIVSAVLKIPSAEGRWKACNTCASHLMVVTLLFGTALFVYLRPSSSYLLGRDKVVSVFYSLVIPMLNPLIYSLRNKEIKDALWKVLERKKVFS

SEQ ID NO: 59843 - protein, 324 aa, Homo sapiens
  Payload ID: 11830
  Gene Symbol: OR5A2
  Gene Name: olfactory receptor, family 5, subfamily A, member 2
  Uniprot ID: Q8NGI9
  ENSP ID: ENSP00000303834
MAVGRNNTIVTKFILLGLSDHPQMKIFLFMLFLGLYLLTLAWNLSLIALIKMDSHLHMPMYFFLSNLSFLDICYVSSTAPKMLSDIITEQKTISFVGCATQYFVFCGMGLTECFLLAAMAYDRYAAICNPLLYTVLISHTLCLKMVVGAYVGGFLSSFIETYSVYQHDFCGPYMINHFFCDLPPVLALSCSDTFTSEVVTFIVSVVVGIVSVLVVLISYGYIVAAVVKISSATGRTKAFSTCASHLTAVTLFYGSGFFMYMRPSSSYSLNRDKVVSIFYALVIPVVNPIIYSFRNKEIKNAMRKAMERDPGISHGGPFIFMTLG

SEQ ID NO: 59844 - protein, 299 aa, Homo sapiens
  Payload ID: 11831
  Gene Symbol: OR5AC1
  Gene Name: olfactory receptor, family 5, subfamily AC, member 1 (gene/pseudogene)
  ENSP ID: ENSP00000475160
MAEENKILVTHFVLTGLTDHPGLQAPLFLVFLVIYLITLVGNLGLMALIWKDPHLHTPIYLFLGSLAFADACTSSSVTSKMLINFFIKESYAIHGVCHPVLLFWFQCNHRMLPAGSDGLPLCSHMQSLALSSGDVQPLYSVYRYFIFYWFSAFSDSCGFVIINFLQVQYYTLFLLNFTAVQNFLHQSYSYTSDFHLFSIYTSLHFYDSYRLLLLYSLCHPEKEVEGKQSLLYLQCPSALCLFVLRHPLLHVCEFVWISCRSGQNVFFILHNNNSFTKSFYLQPKEQRGYRCPEKNHEEI

SEQ ID NO: 59845 - protein, 309 aa, Homo sapiens
  Payload ID: 11832
  Gene Symbol: OR5AC2
  Gene Name: olfactory receptor, family 5, subfamily AC, member 2
  Uniprot ID: Q9NZP5
  ENSP ID: ENSP00000351466
MDISEGNKTLVTEFVLTGLTDRPWLHVLFFVVFLVVYLITMVGNLGLIVLIWNDPHLHMPMYLFLGGLAFSDACTSTSITPRMLVNFLDKTAMISLAECITQFYFFASSATTECFLLVMMAYDRYVAICNPLLYPVMMSNKLSAQLLSISYVIGFLHPLVHVSLLLRLTFCRFNIIHYFYCEILQLFKISCNGPSINALMIFIFGAFIQIPTLMTIIISYTRVLFDILKKKSEKGRSKAFSTCGAHLLSVSLYYGTLIFMYVRPASGLAEDQDKVYSLFYTIIIPLLNPFIYSLRNKKVMHALRRVIRK

SEQ ID NO: 59846 - protein, 309 aa, Homo sapiens
  Payload ID: 11833
  Gene Symbol: OR5AK2
  Gene Name: olfactory receptor, family 5, subfamily AK, member 2
  Uniprot ID: Q8NH90
  ENSP ID: ENSP00000322784
MTLGNSTEVTEFYLLGFGAQHEFWCILFIVFLLIYVTSIMGNSGIILLINTDSRFQTLTYFFLQHLAFVDICYTSAITPKMLQSFTEEKNLMLFQGCVIQFLVYATFATSDCYLLAMMAVDPYVAICKPLHYTVIMSRTVCIRLVAGSYIMGSINASVQTGFTCSLSFCKSNSINHFFCDVPPILALSCSNVDINIMLLVVFVGSNLIFTGLVVIFSYIYIMATILKMSSSAGRKKSFSTCASHLTAVTIFYGTLSYMYLQSHSNNSQENMKVAFIFYGTVIPMLNPLIYSLRNKEVKEALKVIGKKLF

SEQ ID NO: 59847 - protein, 311 aa, Homo sapiens
  Payload ID: 11834
  Gene Symbol: OR5AN1
  Gene Name: olfactory receptor, family 5, subfamily AN, member 1
  Uniprot ID: Q8NGI8
  ENSP ID: ENSP00000320302
MTGGGNITEITYFILLGFSDFPRIIKVLFTIFLVIYITSLAWNLSLIVLIRMDSHLHTPMYFFLSNLSFIDVCYISSTVPKMLSNLLQEQQTITFVGCIIQYFIFSTMGLSESCLMTAMAYDRYAAICNPLLYSSIMSPTLCVWMVLGAYMTGLTASLFQIGALLQLHFCGSNVIRHFFCDMPQLLILSCTDTFFVQVMTAILTMFFGIASALVIMISYGYIGISIMKITSAKGRSKAFNTCASHLTAVSLFYTSGIFVYLSSSSGGSSSFDRFASVFYTVVIPMLNPLIYSLRNKEIKDALKRLQKRKCC

SEQ ID NO: 59848 - protein, 316 aa, Homo sapiens
  Payload ID: 11835
  Gene Symbol: OR5AP2
  Gene Name: olfactory receptor, family 5, subfamily AP, member 2
  Uniprot ID: Q8NGF4
  ENSP ID: ENSP00000303111
MRLMKEVRGRNQTEVTEFLLLGLSDNPDLQGVLFALFLLIYMANMVGNLGMIVLIKIDLCLHTPMYFFLSSLSFVDASYSSSVTPKMLVNLMAENKAISFHGCAAQFYFFGSFLGTECFLLAMMAYDRYAAIWNPLLYPVLVSGRICFLLIATSFLAGCGNAAIHTGMTFRLSFCGSNRINHFYCDTPPLLKLSCSDTHFNGIVIMAFSSFIVISCVMIVLISYLCIFIAVLKMPSLEGRHKAFSTCASYLMAVTIFFGTILFMYLRPTSSYSMEQDKVVSVFYTVIIPVLNPLIYSLKNKDVKKALKKILWKHIL

SEQ ID NO: 59849 - protein, 317 aa, Homo sapiens
  Payload ID: 11835
  Gene Symbol: OR5AP2
  Gene Name: olfactory receptor, family 5, subfamily AP, member 2
  ENSP ID: ENSP00000442701
MMRLMKEVRGRNQTEVTEFLLLGLSDNPDLQGVLFALFLLIYMANMVGNLGMIVLIKIDLCLHTPMYFFLSSLSFVDASYSSSVTPKMLVNLMAENKAISFHGCAAQFYFFGSFLGTECFLLAMMAYDRYAAIWNPLLYPVLVSGRICFLLIATSFLAGCGNAAIHTGMTFRLSFCGSNRINHFYCDTPPLLKLSCSDTHFNGIVIMAFSSFIVISCVMIVLISYLCIFIAVLKMPSLEGRHKAFSTCASYLMAVTIFFGTILFMYLRPTSSYSMEQDKVVSVFYTVIIPVLNPLIYSLKNKDVKKALKKILWKHIL

SEQ ID NO: 59850 - protein, 310 aa, Homo sapiens; identical to SEQ ID NO: 59441
  Payload ID: 11836
  Gene Symbol: OR5AR1
  Gene Name: olfactory receptor, family 5, subfamily AR, member 1 (gene/pseudogene)
  Uniprot ID: Q8NGP9
  ENSP ID: ENSP00000485424

SEQ ID NO: 59851 - protein, 324 aa, Homo sapiens
  Payload ID: 11837
  Gene Symbol: OR5AS1
  Gene Name: olfactory receptor, family 5, subfamily AS, member 1
  Uniprot ID: Q8N127
  ENSP ID: ENSP00000324111
MLESNYTMPTEFLFVGFTDYLPLRVTLFLVFLLVYTLTMVGNILLIILVNINSSLQIPMYYFLSNLSFLDISCSTAITPKMLANFLASRKSISPYGCALQMFFFASFADAECLILAAMAYDRYAAICNPLLYTTLMSRRVCVCFIVLAYFSGSTTSLVHVCLTFRLSFCGSNIVNHFFCDIPPLLALSCTDTQINQLLLFALCSFIQTSTFVVIFISYFCILITVLSIKSSGGRSKTFSTCASHLIAVTLFYGALLFMYLQPTTSYSLDTDKVVAVFYTVVFPMFNPIIYSFRNKDVKNALKKLLERIGYSNEWYLNRLRIVNI

SEQ ID NO: 59852 - protein, 362 aa, Homo sapiens
  Payload ID: 11838
  Gene Symbol: OR5AU1
  Gene Name: olfactory receptor, family 5, subfamily AU, member 1
  Uniprot ID: Q8NGC0
  ENSP ID: ENSP00000302057
MTEFHLQSQMPSIRLIFRRLSLGRIKPSQSPRCSTSFMVVPSFSIAEHWRRMKGANLSQGMEFELLGLTTDPQLQRLLFVVFLGMYTATLLGNLVMFLLIHVSATLHTPMYSLLKSLSFLDFCYSSTVVPQTLVNFLAKRKVISYFGCMTQMFFYAGFATSECYLIAAMAYDRYAAICNPLLYSTIMSPEVCASLIVGSYSAGFLNSLIHTGCIFSLKFCGAHVVTHFFCDGPPILSLSCVDTSLCEILLFIFAGFNLLSCTLTILISYFLILNTILKMSSAQGRFKAFSTCASHLTAICLFFGTTLFMYLRPRSSYSLTQDRTVAVIYTVVIPVLNPLMYSLRNKDVKKALIKVWGRKTME

SEQ ID NO: 59853 - protein, 314 aa, Homo sapiens
  Payload ID: 11839
  Gene Symbol: OR5B12
  Gene Name: olfactory receptor, family 5, subfamily B, member 12
  Uniprot ID: Q96R08
  ENSP ID: ENSP00000306657
MENNTEVTEFILVGLTDDPELQIPLFIVFLFIYLITLVGNLGMIELILLDSCLHTPMYFFLSNLSLVDFGYSSAVTPKVMVGFLTGDKFILYNACATQFFFFVAFITAESFLLASMAYDRYAALCKPLHYTTTMTTNVCACLAIGSYICGFLNASIHTGNTFRLSFCRSNVVEHFFCDAPPLLTLSCSDNYISEMVIFFVVGFNDLFSILVILISYLFIFITIMKMRSPEGRQKAFSTCASHLTAVSIFYGTGIFMYLRPNSSHFMGTDKMASVFYAIVIPMLNPLVYSLRNKEVKSAFKKTVGKAKASIGFIF

SEQ ID NO: 59854 - protein, 314 aa, Homo sapiens
  Payload ID: 11840
  Gene Symbol: OR5B17
  Gene Name: olfactory receptor, family 5, subfamily B, member 17
  Uniprot ID: Q8NGF7
  ENSP ID: ENSP00000349945
MENNTEVSEFILLGLTNAPELQVPLFIMFTLIYLITLTGNLGMIILILLDSHLHTPMYFFLSNLSLAGIGYSSAVTPKVLTGLLIEDKAISYSACAAQMFFCAVFATVENYLLSSMAYDRYAAVCNPLHYTTTMTTRVCACLAIGCYVIGFLNASIQIGDTFRLSFCMSNVIHHFFCDKPAVITLTCSEKHISELILVLISSFNVFFALLVTLISYLFILITILKRHTGKGYQKPLSTCGSHLIAIFLFYITVIIMYIRPSSSHSMDTDKIASVFYTMIIPMLSPIVYTLRNKDVKNAFMKVVEKAKYSLDSVF

SEQ ID NO: 59855 - protein, 309 aa, Homo sapiens
  Payload ID: 11841
  Gene Symbol: OR5B2
  Gene Name: olfactory receptor, family 5, subfamily B, member 2
  Uniprot ID: Q96R09
  ENSP ID: ENSP00000303076
MENCTEVTKFILLGLTSVPELQIPLFILFTFIYLLTLCGNLGMMLLILMDSCLHTPMYFFLSNLSLVDFGYSSAVTPKVMAGFLRGDKVISYNACAVQMFFFVALATVENYLLASMAYDRYAAVCKPLHYTTTMTASVGACLALGSYVCGFLNASFHIGGIFSLSFCKSNLVHHFFCDVPAVMALSCSDKHTSEVILVFMSSFNIFFVLLVIFISYLFIFITILKMHSAKGHQKALSTCASHFTAVSVFYGTVIFIYLQPSSSHSMDTDKMASVFYAMIIPMLNPVVYSLRNREVQNAFKKVLRRQKFL

SEQ ID NO: 59856 - protein, 309 aa, Homo sapiens
  Payload ID: 11842
  Gene Symbol: OR5B21
  Gene Name: olfactory receptor, family 5, subfamily B, member 21
  Uniprot ID: A6NL26
  ENSP ID: ENSP00000353537
MENSTEVTEFILLGLTDDPNLQIPLLLAFLFIYLITLLGNGGMMVIIHSDSHLHTPMYFFLSNLSLVDLGYSSAVAPKTVAALRSGDKAISYDGCAAQFFFFVGFATVECYLLASMAYDRHAAVCRPLHYTTTMTAGVCALLATGSYVSGFLNASIHAAGTFRLSFCGSNEINHFFCDIPPLLALSCSDTRISKLVVFVAGFNVFFTLLVILISYFFICITIQRMHSAEGQKKVFSTCASHLTALSIFYGTIIFMYLQPNSSQSVDTDKIASVFYTVVIPMLNPLIYSLRNKEVKSALWKILNKLYPQY

SEQ ID NO: 59857 - protein, 314 aa, Homo sapiens
  Payload ID: 11843
  Gene Symbol: OR5B3
  Gene Name: olfactory receptor, family 5, subfamily B, member 3
  Uniprot ID: Q8NH48
  ENSP ID: ENSP00000308270
MENKTEVTQFILLGLTNDSELQVPLFITFPFIYIITLVGNLGIIVLIFWDSCLHNPMYFFLSNLSLVDFCYSSAVTPIVMAGFLIEDKVISYNACAAQMYIFVAFATVENYLLASMAYDRYAAVCKPLHYTTTMTTTVCARLAIGSYLCGFLNASIHTGDTFSLSFCKSNEVHHFFCDIPAVMVLSCSDRHISELVLIYVVSFNIFIALLVILISYTFIFITILKMHSASVYQKPLSTCASHFIAVGIFYGTIIFMYLQPSSSHSMDTDKMAPVFYTMVIPMLNPLVYSLRNKEVKSAFKKVVEKAKLSVGWSV

SEQ ID NO: 59858 - protein, 320 aa, Homo sapiens
  Payload ID: 11844
  Gene Symbol: OR5C1
  Gene Name: olfactory receptor, family 5, subfamily C, member 1
  Uniprot ID: Q8NGR4
  ENSP ID: ENSP00000362784
MNSENLTRAAVAPAEFVLLGITNRWDLRVALFLTCLPVYLVSLLGNMGMALLIRMDARLHTPMYFFLANLSLLDACYSSAIGPKMLVDLLLPRATIPYTACALQMFVFAGLADTECCLLAAMAYDRYVAIRNPLLYTTAMSQRLCLALLGASGLGGAVSAFVHTTLTFRLSFCRSRKINSFFCDIPPLLAISCSDTSLNELLLFAICGFIQTATVLAITVSYGFIAGAVIHMRSVEGSRRAASTGGSHLTAVAMMYGTLIFMYLRPSSSYALDTDKMASVFYTLVIPSLNPLIYSLRNKEVKEALRQTWSRFHCPGQGSQ

SEQ ID NO: 59859 - protein, 314 aa, Homo sapiens
  Payload ID: 11845
  Gene Symbol: OR5D13
  Gene Name: olfactory receptor, family 5, subfamily D, member 13 (gene/pseudogene)
  Uniprot ID: Q8NGL4
  ENSP ID: ENSP00000354800
MMASERNQSSTPTFILLGFSEYPEIQVPLFLVFLFVYTVTVVGNLGMIIIIRLNSKLHTIMCFFLSHLSLTDFCFSTVVTPKLLENLVVEYRTISFSGCIMQFCFACIFGVTETFMLAAMAYDRFVAVCKPLLYTTIMSQKLCALLVAGSYTWGIVCSLILTYFLLDLSFCESTFINNFICDHSVIVSASYSDPYISQRLCFIIAIFNEVSSLIIILTSYMLIFTTIMKMRSASGRQKTFSTCASHLTAITIFHGTILFLYCVPNPKTSSLIVTVASVFYTVAIPMLNPLIYSLRNKDINNMFEKLVVTKLIYH

SEQ ID NO: 59860 - protein, 314 aa, Homo sapiens
  Payload ID: 11846
  Gene Symbol: OR5D14
  Gene Name: olfactory receptor, family 5, subfamily D, member 14
  Uniprot ID: Q8NGL3
  ENSP ID: ENSP00000334456
MMMVLRNLSMEPTFALLGFTDYPKLQIPLFLVFLLMYVITVVGNLGMIIIIKINPKFHTPMYFFLSHLSFVDFCYSSIVTPKLLENLVMADKSIFYFSCMMQYFLSCTAVVTESFLLAVMAYDRFVAICNPLLYTVAMSQRLCALLVAGSYLWGMFGPLVLLCYALRLNFSGPNVINHFFCEYTALISVSGSDILIPHLLLFSFATFNEMCTLLIILTSYVFIFVTVLKIRSVSGRHKAFSTWASHLTSITIFHGTILFLYCVPNSKNSRQTVKVASVFYTVVNPMLNPLIYSLRNKDVKDAFWKLIHTQVPFH

SEQ ID NO: 59861 - protein, 328 aa, Homo sapiens
  Payload ID: 11847
  Gene Symbol: OR5D16
  Gene Name: olfactory receptor, family 5, subfamily D, member 16
  Uniprot ID: Q8NGK9
  ENSP ID: ENSP00000367649
MFLTERNTTSEATFTLLGFSDYLELQIPLFFVFLAVYGFSVVGNLGMIVIIKINPKLHTPMYFFLNHLSFVDFCYSSIIAPMMLVNLVVEDRTISFSGCLVQFFFFCTFVVTELILFAVMAYDHFVAICNPLLYTVAISQKLCAMLVVVLYAWGVACSLTLACSALKLSFHGFNTINHFFCELSSLISLSYPDSYLSQLLLFTVATFNEISTLLIILTSYAFIIVTTLKMPSASGHRKVFSTCASHLTAITIFHGTILFLYCVPNSKNSRHTVKVASVFYTVVIPLLNPLIYSLRNKDVKDAIRKIINTKYFHIKHRHWYPFNFVIEQ

SEQ ID NO: 59862 - protein, 313 aa, Homo sapiens
  Payload ID: 11848
  Gene Symbol: OR5D18
  Gene Name: olfactory receptor, family 5, subfamily D, member 18
  Uniprot ID: Q8NGL1
  ENSP ID: ENSP00000335025
MLLTDRNTSGTTFTLLGFSDYPELQVPLFLVFLAIYNVTVLGNIGLIVIIKINPKLHTPMYFFLSQLSFVDFCYSSIIAPKMLVNLVVKDRTISFLGCVVQFFFFCTFVVTESFLLAVMAYDRFVAICNPLLYTVNMSQKLCVLLVVGSYAWGVSCSLELTCSALKLCFHGFNTINHFFCEFSSLLSLSCSDTYINQWLLFFLATFNEISTLLIVLTSYAFIVVTILKMRSVSGRRKAFSTCASHLTAITIFHGTILFLYCVPNSKNSRHTVKVASVFYTVVIPMLNPLIYSLRNKDVKDTVTEILDTKVFSY

SEQ ID NO: 59863 - protein, 314 aa, Homo sapiens
  Payload ID: 11849
  Gene Symbol: OR5F1
  Gene Name: olfactory receptor, family 5, subfamily F, member 1
  Uniprot ID: O95221
  ENSP ID: ENSP00000278409
MTRKNYTSLTEFVLLGLADTLELQIILFLFFLVIYTLTVLGNLGMILLIRIDSQLHTPMYFFLANLSFVDVCNSTTITPKMLADLLSEKKTISFAGCFLQMYFFISLATTECILFGLMAYDRYAAICRPLLYSLIMSRTVYLKMAAGAFAAGLLNFMVNTSHVSSLSFCDSNVIHHFFCDSPPLFKLSCSDTILKESISSILAGVNIVGTLLVILSSYSYVLFSIFSMHSGEGRHRAFSTCASHLTAIILFYATCIYTYLRPSSSYSLNQDKVASVFYTVVIPMLNPLIYSLRSKEVKKALANVISRKRTSSFL

SEQ ID NO: 59864 - protein, 293 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000477337
NQTVVTEFLLLGLTDHPYQKIVLFFMFLFVYLITLGGNLGMITLIWIDPRLHTPMYFFLRHLSFVDICSSSSVVPKMLCNIFAEKKDITFLGCAAQMWFFGLFEAAECFLWLPWHMTGMWPSASPCCIRSLCLSRSVCSWWGLMPWLLAPLIQFSLFAYPFVVQILSITFSVIFFHCFPHVQTPGINLCCLSWLELEYSVVSSWSPIFASPSRSRLLMGSKKLSSPVFLTLRLSPSCMGLFSFMFGQVQVPPWVSIKFLYFILWSPWLTPLFTAGIRRKMHSEEKLRGKNLLV

SEQ ID NO: 59865 - protein, 296 aa, Homo sapiens
  Payload ID: 11850
  Gene Symbol: OR5G3
  Gene Name: olfactory receptor, family 5, subfamily G, member 3 (gene/pseudogene)
  ENSP ID: ENSP00000485881
MEDKNQTVVTEFLLLGLTDHPYQKIVLFFMFLFVYLITLGGNLGMITLIWIDPRLHTPMYFFLRHLSFVDICSSSSVVPKMLCNIFAEKKDITFLGCAAQMWFFGLFEAAECFLWLPWHMTGMWPSASPCCIRSLCLSRSVCSWWGLMPWLLAPLIQFSLFAYPFVVQILSITFSVIFFHCFPHVQTPGINLCCLSWLELEYSVVSSWSPIFASPSRSRLLMGSKKLSSPVFLTLRLSPSCMGLFSFMFGQVQVPPWVSIKFLYFILWSPWLTPLFTAGIRRKMHSEEKLRGKNLL

SEQ ID NO: 59866 - protein, 313 aa, Homo sapiens
  Payload ID: 11851
  Gene Symbol: OR5H1
  Gene Name: olfactory receptor, family 5, subfamily H, member 1
  Uniprot ID: A6NKK0
  ENSP ID: ENSP00000346575
MEEENATLLTEFVLTGFLYQPQWKIPLFLAFLVIYLITIMGNLGLIAVIWKDPHLHIPMYLLLGNLAFVDAWISSTVTPKMLNNFLAKSKMISLSECKIQFFSFAISVTTECFLLATMAYDRYVAICKPLLYPAIMTNGLCIRLLILSYVGGILHALIHEGFLFRLTFCNSNIVHHIYCDTIPLSKISCTDSSINFLMVFIFSGSIQVFSIVTILVSYTFVLFAILKKKSDKGVRKAFSTCGAHLFSVSLYYGPLLFIYVGPASPQADDQDMVEPLFYTVIIPLLNPIIYSLRNKQVTVSFTKMLKKHVKVSY

SEQ ID NO: 59867 - protein, 310 aa, Homo sapiens
  Payload ID: 11852
  Gene Symbol: OR5H14
  Gene Name: olfactory receptor, family 5, subfamily H, member 14
  Uniprot ID: A6NHG9
  ENSP ID: ENSP00000401706
MEEENATLLTEFVLTGFLYQPQWKIPLFLAFLVIYLITIMGNLGLIAVIWKDPHLHIPMYLLLGNLAFVDALLSSSVTLKMLINFLAKSKMISLSECKIQLFSFAISVTTECFLLATMAYDRYVAICKPLLYPAIMTNGLCIRLLILSYVGGLLHALIHEGFLFRLTFCNSNIIQHFYCDIIPLLKISYTDSSINFLMVFIFAGSIQVFTIGTVLISYIFVLYTILKKKSVKGMRKAFSTCGAHLLSVSLYYGPLAFMYMGSASPQADDQDMMESLFYTVIVPLLNPMIYSLRNKQVIASFTKMFKRNDV

SEQ ID NO: 59868 - protein, 313 aa, Homo sapiens
  Payload ID: 11853
  Gene Symbol: OR5H15
  Gene Name: olfactory receptor, family 5, subfamily H, member 15
  Uniprot ID: A6NDH6
  ENSP ID: ENSP00000373195
MEEENATLLTEFVLTGFLYQPQWKIPLFLAFLVIYLITIMGNLGLIAVIWKDPHLHIPMYLLLGNLAFVDAWISSTVTPKMLNNFLAKSKMISLSECKIQFFSIAIGVTTECFLLATMAYDRYVAICKPLLYPAIMTNGLCIRLLILSYIAGILHALIHEGFLFRLTFCNSNIVHHIYCDTIPLSKISCTDSSINFLMVFIFSGSIQVFSIVTILISYTFVLFTVLEKKSDKGVRKAFSTCGAHLFSVCLYYGPLLLMYVGPASPQADGQNMVEPLFYTVIIPLLNPIIYSLRNKQVIVSFIKMLKRNVKVSY

SEQ ID NO: 59869 - protein, 310 aa, Homo sapiens
  Payload ID: 11853
  Gene Symbol: OR5H15
  Gene Name: olfactory receptor, family 5, subfamily H, member 15
  ENSP ID: ENSP00000480705
MEEENATLLTEFVLTGFLYQPQWKIPLFLAFLVIYLITIMGNLGLIAVIWKDPHLHIPMYLLLGNLAFVDAWISSTVTPKMLNNFLAKSKMISLSECKIQFFSIAIGVTTECFLLATMAYDRYVAICKPLLYPAIMTNGLCIRLLILSYIAGILHALIHEGFLFRLTFCNSNIVHHIYCDTIPLSKISCTDSSINFLMVFIFSGSIQVFTIGTVLVSYTFVLSTILKKKSVKGIRKDFSTCGAHILPVSLYYGPLAFMYVGSASQRADDQDMMESLFYTVIVPLLNPMIYSLRNKQVIDSFTKMFKGNNV

SEQ ID NO: 59870 - protein, 314 aa, Homo sapiens
  Payload ID: 11854
  Gene Symbol: OR5H2
  Gene Name: olfactory receptor, family 5, subfamily H, member 2
  Uniprot ID: Q8NGV7
  ENSP ID: ENSP00000347418
MSNEDMEQDNTTLLTEFVLTGLTYQPEWKMPLFLVFLVIYLITIVWNLGLIALIWNDPQLHIPMYFFLGSLAFVDAWISSTVTPKMLVNFLAKNRMISLSECMIQFFSFAFGGTTECFLLATMAYDRYVAICKPLLYPVIMNNSLCIRLLAFSFLGGFLHALIHEVLIFRLTFCNSNIIHHFYCDIIPLFMISCTDPSINFLMVFILSGSIQVFTIVTVLNSYTFALFTILKKKSVRGVRKAFSTCGAHLLSVSLYYGPLIFMYLRPASPQADDQDMIDSVFYTIIIPLLNPIIYSLRNKQVIDSFTKMVKRNV

SEQ ID NO: 59871 - protein, 325 aa, Homo sapiens
  Payload ID: 11855
  Gene Symbol: OR5H6
  Gene Name: olfactory receptor, family 5, subfamily H, member 6 (gene/pseudogene)
  Uniprot ID: Q8NGV6
  ENSP ID: ENSP00000373196
MFLYLCFIFQRTCSEEMEEENATLLTEFVLTGFLHQPDCKIPLFLAFLVIYLITIMGNLGLIVLIWKDPHLHIPMYLFLGSLAFVDASLSSTVTPKMLINFLAKSKMISLSECMVQFFSLVTTVTTECFLLATMAYDRYVAICKALLYPVIMTNELCIQLLVLSFIGGLLHALIHEAFSFRLTFCNSNIIQHFYCDIIPLLKISCTDSSINFLMVFIFAGSVQVFTIGTILISYTIILFTILEKKSIKGIRKAVSTCGAHLLSVSLYYGPLTFKYLGSASPQADDQDMMESLFYTVIVPLLNPMIYSLRNKQVIASFTKMFKSNV

SEQ ID NO: 59872 - protein, 325 aa, Homo sapiens; identical to SEQ ID NO: 59871
  Payload ID: 11855
  Gene Symbol: OR5H6
  Gene Name: olfactory receptor, family 5, subfamily H, member 6 (gene/pseudogene)
  Uniprot ID: Q8NGV6
  ENSP ID: ENSP00000485045

SEQ ID NO: 59873 - protein, 325 aa, Homo sapiens; identical to SEQ ID NO: 59871
  Payload ID: 11855
  Gene Symbol: OR5H6
  Gene Name: olfactory receptor, family 5, subfamily H, member 6 (gene/pseudogene)
  Uniprot ID: Q8NGV6
  ENSP ID: ENSP00000485611

SEQ ID NO: 59874 - protein, 308 aa, Homo sapiens
  Payload ID: 11856
  Gene Symbol: OR5H8
  Gene Name: olfactory receptor, family 5, subfamily H, member 8 (gene/pseudogene)
  ENSP ID: ENSP00000476186
MDDENATLLTEFVLTGLTYQSEWKIPLFLAFLVIYLITIMANLGLIAVIWKDSHLHIPMYLFLGSLAFVDAWLSSSVTPKMLISFLAKSMIISVSECKIQFFSFGISGTTECFLLATMAYDRYVAICKPLLYPVIMTNGLCIWLLVLSFIGGFLHALIHEGILFRLTFCNSNIIHHFYCDIIPLLKISCTDPSINFLMLFILSGSIQVFTILTVLVSYTFVLFTILKKKVCQRHKESLFHLWSPSLICFFILWPPSLHVCAPCISTSRSRYGGVSILHCHNSFLKSHYLQPEKASHRFTDKNIKRKCL

SEQ ID NO: 59875 - protein, 314 aa, Homo sapiens
  Payload ID: 11857
  Gene Symbol: OR5I1
  Gene Name: olfactory receptor, family 5, subfamily I, member 1
  Uniprot ID: Q13606
  ENSP ID: ENSP00000301532
MEFTDRNYTLVTEFILLGFPTRPELQIVLFLMFLTLYAIILIGNIGLMLLIRIDPHLQTPMYFFLSNLSFVDLCYFSDIVPKMLVNFLSENKSISYYGCALQFYFFCTFADTESFILAAMAYDRYVAICNPLLYTVVMSRGICMRLIVLSYLGGNMSSLVHTSFAFILKYCDKNVINHFFCDLPPLLKLSCTDTTINEWLLSTYGSSVEIICFIIIIISYFFILLSVLKIRSFSGRKKTFSTCASHLTSVTIYQGTLLFIYSRPSYLYSPNTDKIISVFYTIFIPVLNPLIYSLRNKDVKDAAEKVLRSKVDSS

SEQ ID NO: 59876 - protein, 312 aa, Homo sapiens
  Payload ID: 11858
  Gene Symbol: OR5J2
  Gene Name: olfactory receptor, family 5, subfamily J, member 2
  Uniprot ID: Q8NH18
  ENSP ID: ENSP00000310788
MADDNFTVVTEFILLGLTDHAELKAVLFVVFLVIYAITLLRNLGMILLIQITSKLHTPMYFLLSCLSFVDACYSSAIAPKMLVNLLVVKATISFSACMVQHLCFGVFITTEGFLLSVMAYDRYVAIVSPLLYTVAMSDRKCVELVTGSWIGGIVNTLIHTISLRRLSFCRLNAVSHFFCDIPSLLKLSCSDTSMNELLLLTFSGVIAMATFLTVIISYIFIAFASLRIHSASGRQQAFSTCASHLTAVTIFYGTLIFSYIQPSSQYFVEQEKVVSMFYTLGIPMLNLLIHSLRNKDVKEAVKRAIEMKHFLC

SEQ ID NO: 59877 - protein, 308 aa, Homo sapiens
  Payload ID: 11859
  Gene Symbol: OR5K1
  Gene Name: olfactory receptor, family 5, subfamily K, member 1
  Uniprot ID: Q8NHB7
  ENSP ID: ENSP00000373193
MAEENHTMKNEFILTGFTDHPELKTLLFVVFFAIYLITVVGNISLVALIFTHRRLHTPMYIFLGNLALVDSCCACAITPKMLENFFSENKRISLYECAVQFYFLCTVETADCFLLAAMAYDRYVAICNPLQYHIMMSKKLCIQMTTGAFIAGNLHSMIHVGLVFRLVFCGSNHINHFYCDILPLYRLSCVDPYINELVLFIFSGSVQVFTIGSVLISYLYILLTIFKMKSKEGRAKAFSTCASHFLSVSLFYGSLFFMYVRPNLLEEGDKDIPAAILFTIVVPLLNPFIYSLRNREVISVLRKILMKK

SEQ ID NO: 59878 - protein, 316 aa, Homo sapiens
  Payload ID: 11860
  Gene Symbol: OR5K2
  Gene Name: olfactory receptor, family 5, subfamily K, member 2
  Uniprot ID: Q8NHB8
  ENSP ID: ENSP00000393889
MVEENHTMKNEFILTGFTDHPELKTLLFVVFFAIYLITVVGNISLVALIFTHCRLHTPMYIFLGNLALVDSCCACAITPKMLENFFSEGKRISLYECAVQFYFLCTVETADCFLLAAVAYDRYVAICNPLQYHIMMSKKLCIQMTTGAFIAGNLHSMIHVGLVFRLVFCGLNHINHFYCDTLPLYRLSCVDPFINELVLFIFSGSVQVFTIGSVLISYLYILLTIFRMKSKEGRAKAFSTCASHFSSVSLFYGSIFFLYIRPNLLEEGGNDIPAAILFTIVVPLLNPFIYSLRNKEVISVLRKILLKIKSQGSVNK

SEQ ID NO: 59879 - protein, 321 aa, Homo sapiens
  Payload ID: 11861
  Gene Symbol: OR5K3
  Gene Name: olfactory receptor, family 5, subfamily K, member 3
  Uniprot ID: A6NET4
  ENSP ID: ENSP00000373194
MNKENHSLIAEFILTGFTYHPKLKTVLFVVFFAIYLITMVGNIGLVALIYIEQRLHTPMYIFLGNLVLMDSCCSSAITPKMLENFFSEDKRITLYECMAQFYFLCLAETTDCFLLAAMAYDCYVAICNPLQYHTMMSKTLCIQMTAGAYLAGNLHPMIEVEFLLRLTFCGSHQINHFFCDVLPLYRLSCINPYINELVLFILAGSIQIFTIVLVSYFYILFTIFTMKSKEGRGKALSTCASHFLSVSIFCDSLLFMYARPGAVNEGDKDIPVAIFYTLVIPLLNPFIYSLRNKEVINIMKKIMKKRKFCHILKQMSSPLAT

SEQ ID NO: 59880 - protein, 321 aa, Homo sapiens
  Payload ID: 11862
  Gene Symbol: OR5K4
  Gene Name: olfactory receptor, family 5, subfamily K, member 4
  Uniprot ID: A6NMS3
  ENSP ID: ENSP00000347003
MARENHSLAAEFILIGFTNYPELKTLLFVVFSAIYLVTMVGNLGLVALIYVERRLLTPMYIFLGNLALMDSCCSCAVTPKMLENFFSEDRIISLYECMAQFYFLCLAETTDCFLLATMAYDRYVAICHPLQYHTMMSKTLCIRMTTGAFKAGNLHSMIHVGLLLRLTFCRSNKIHHFFCDILPLYRLSCTDPSINELMIYIFSIPIQIFTIATVLISYLCILLTVFKMKSKEGRGKAFSTCASHFLSVSIFYICLLMYIGPSEEGDKDTPVAIFYAIVIPLLNPFIYSLRNKEVINVLKKIMRNYNILKQTCSIANLFLIY

SEQ ID NO: 59881 - protein, 311 aa, Homo sapiens; identical to SEQ ID NO: 59443
  Payload ID: 11863
  Gene Symbol: OR5L1
  Gene Name: olfactory receptor, family 5, subfamily L, member 1 (gene/pseudogene)
  Uniprot ID: Q8NGL2
  ENSP ID: ENSP00000335529

SEQ ID NO: 59882 - protein, 311 aa, Homo sapiens
  Payload ID: 11864
  Gene Symbol: OR5L2
  Gene Name: olfactory receptor, family 5, subfamily L, member 2
  Uniprot ID: Q8NGL0
  ENSP ID: ENSP00000367650
MGKENCTTVAEFILLGLSDVPELRVCLFLLFLLIYGVTLLANLGMTALIQVSSRLHTPVYFFLSHLSFVDFCYSSIIVPKMLANIFNKDKAISFLGCMVQFYLFCTCGVTEVFLLAVMAYDRFVAICNPLLYMVTMSQKLRVELTSCCYFCGTVCSLIHSSLALRILFYRSNVINHFFCDLPPLLSLACSDVTVNETLLFLVATLNESVTIMIILTSYLLILTTILKIHSAESRHKAFSTCASHLTAITVSHGTILYIYCRPSSGNSGDVDKVATVFYTVVIPMLNPLIYSLRNKDVNKALRKVMGSKIHS

SEQ ID NO: 59883 - protein, 315 aa, Homo sapiens
  Payload ID: 11865
  Gene Symbol: OR5M1
  Gene Name: olfactory receptor, family 5, subfamily M, member 1
  Uniprot ID: Q8NGP8
  ENSP ID: ENSP00000435416
MFSPNHTIVTEFILLGLTDDPVLEKILFGVFLAIYLITLAGNLCMILLIRTNSHLQTPMYFFLGHLSFVDICYSSNVTPNMLHNFLSEQKTISYAGCFTQCLLFIALVITEFYILASMALDRYVAICSPLHYSSRMSKNICVCLVTIPYMYGFLSGFSQSLLTFHLSFCGSLEINHFYCADPPLIMLACSDTRVKKMAMFVVAGFNLSSSLFIILLSYLFIFAAIFRIRSAEGRHKAFSTCASHLTIVTLFYGTLFCMYVRPPSEKSVEESKITAVFYTFLSPMLNPLIYSLRNTDVILAMQQMIRGKSFHKIAV

SEQ ID NO: 59884 - protein, 315 aa, Homo sapiens
  Payload ID: 11866
  Gene Symbol: OR5M10
  Gene Name: olfactory receptor, family 5, subfamily M, member 10
  Uniprot ID: Q6IEU7
  ENSP ID: ENSP00000436004
MLSPNHTIVTEFILLGLTDDPVLEKILFGVFLAIYLITLAGNLCMILLIRTNSQLQTPMYFFLGHLSFVDICYSSNVTPNMLHNFLSEQKTISYAGCFTQCLLFIALVITEFYFLASMALDRYVAICSPLHYSSRMSKNICISLVTVPYMYGFLNGLSQTLLTFHLSFCGSLEINHFYCADPPLIMLACSDTRVKKMAMFVVAGFTLSSSLFIILLSYLFIFAAIFRIRSAEGRHKAFSTCASHLTIVTLFYGTLFCMYVRPPSEKSVEESKIIAVFYTFLSPMLNPLIYSLRNRDVILAIQQMIRGKSFCKIAV

SEQ ID NO: 59885 - protein, 305 aa, Homo sapiens
  Payload ID: 11867
  Gene Symbol: OR5M11
  Gene Name: olfactory receptor, family 5, subfamily M, member 11
  Uniprot ID: Q96RB7
  ENSP ID: ENSP00000432417
MSNTNGSAITEFILLGLTDCPELQSLLFVLFLVVYLVTLLGNLGMIMLMRLDSRLHTPMYFFLTNLAFVDLCYTSNATPQMSTNIVSEKTISFAGCFTQCYIFIALLLTEFYMLAAMAYDRYVAIYDPLRYSVKTSRRVCICLATFPYVYGFSDGLFQAILTFRLTFCRSSVINHFYCADPPLIKLSCSDTYVKEHAMFISAGFNLSSSLTIVLVSYAFILAAILRIKSAEGRHKAFSTCGSHMMAVTLFYGTLFCMYIRPPTDKTVEESKIIAVFYTFVSPVLNPLIYSLRNKDVKQALKNVLR

SEQ ID NO: 59886 - protein, 307 aa, Homo sapiens
  Payload ID: 11868
  Gene Symbol: OR5M3
  Gene Name: olfactory receptor, family 5, subfamily M, member 3
  Uniprot ID: Q8NGP4
  ENSP ID: ENSP00000312208
MLNFTDVTEFILLGLTSRREWQVLFFIIFLVVYIITMVGNIGMMVLIKVSPQLNNPMYFFLSHLSFVDVWFSSNVTPKMLENLLSDKKTITYAGCLVQCFFFIALVHVEIFILAAMAFDRYMAIGNPLLYGSKMSRVVCIRLITFPYIYGFLTSLAATLWTYGLYFCGKIEINHFYCADPPLIKMACAGTFVKEYTMIILAGINFTYSLTVIIISYLFILIAILRMRSAEGRQKAFSTCGSHLTAVIIFYGTLIFMYLRRPTEESVEQGKMVAVFYTTVIPMLNPMIYSLRNKDVKKAMMKVISRSC

SEQ ID NO: 59887 - protein, 311 aa, Homo sapiens
  Payload ID: 11869
  Gene Symbol: OR5M8
  Gene Name: olfactory receptor, family 5, subfamily M, member 8
  Uniprot ID: Q8NGP6
  ENSP ID: ENSP00000323354
MRRNCTLVTEFILLGLTSRRELQILLFTLFLAIYMVTVAGNLGMIVLIQANAWLHMPMYFFLSHLSFVDLCFSSNVTPKMLEIFLSEKKSISYPACLVQCYLFIALVHVEIYILAVMAFDRYMAICNPLLYGSRMSKSVCSFLITVPYVYGALTGLMETMWTYNLAFCGPNEINHFYCADPPLIKLACSDTYNKELSMFIVAGWNLSFSLFIICISYLYIFPAILKIRSTEGRQKAFSTCGSHLTAVTIFYATLFFMYLRPPSKESVEQGKMVAVFYTTVIPMLNLIIYSLRNKNVKEALIKELSMKIYFS

SEQ ID NO: 59888 - protein, 310 aa, Homo sapiens
  Payload ID: 11870
  Gene Symbol: OR5M9
  Gene Name: olfactory receptor, family 5, subfamily M, member 9
  Uniprot ID: Q8NGP3
  ENSP ID: ENSP00000279791
MPNFTDVTEFTLLGLTCRQELQVLFFVVFLAVYMITLLGNIGMIILISISPQLQSPMYFFLSHLSFADVCFSSNVTPKMLENLLSETKTISYVGCLVQCYFFIAVVHVEVYILAVMAFDRYMAGCNPLLYGSKMSRTVCVRLISVPYVYGFSVSLICTLWTYGLYFCGNFEINHFYCADPPLIQIACGRVHIKEITMIVIAGINFTYSLSVVLISYTLIVVAVLRMRSADGRRKAFSTCGSHLTAVSMFYGTPIFMYLRRPTEESVEQGKMVAVFYTTVIPMLNPMIYSLRNKDVKEAVNKAITKTYVRQ

SEQ ID NO: 59889 - protein, 322 aa, Homo sapiens
  Payload ID: 11871
  Gene Symbol: OR5P2
  Gene Name: olfactory receptor, family 5, subfamily P, member 2
  Uniprot ID: Q8WZ92
  ENSP ID: ENSP00000331823
MNSLKDGNHTALTGFILLGLTDDPILRVILFMIILSGNLSIIILIRISSQLHHPMYFFLSHLAFADMAYSSSVTPNMLVNFLVERNTVSYLGCAIQLGSAAFFATVECVLLAAMAYDRFVAICSPLLYSTKMSTQVSVQLLLVVYIAGFLIAVSYTTSFYFLLFCGPNQVNHFFCDFAPLLELSCSDISVSTVVLSFSSGSIIVVTVCVIAVCYIYILITILKMRSTEGHHKAFSTCTSHLTVVTLFYGTITFIYVMPNFSYSTDQNKVVSVLYTVVIPMLNPLIYSLRNKEIKGALKRELVRKILSHDACYFSRTSNNDIT

SEQ ID NO: 59890 - protein, 322 aa, Homo sapiens; identical to SEQ ID NO: 59889
  Payload ID: 11871
  Gene Symbol: OR5P2
  Gene Name: olfactory receptor, family 5, subfamily P, member 2
  Uniprot ID: Q8WZ92
  ENSP ID: ENSP00000480613

SEQ ID NO: 59891 - protein, 322 aa, Homo sapiens; identical to SEQ ID NO: 59889
  Payload ID: 11871
  Gene Symbol: OR5P2
  Gene Name: olfactory receptor, family 5, subfamily P, member 2
  Uniprot ID: Q8WZ92
  ENSP ID: ENSP00000486671

SEQ ID NO: 59892 - protein, 311 aa, Homo sapiens
  Payload ID: 11872
  Gene Symbol: OR5P3
  Gene Name: olfactory receptor, family 5, subfamily P, member 3
  Uniprot ID: Q8WZ94
  ENSP ID: ENSP00000332068
MGTGNDTTVVEFTLLGLSEDTTVCAILFLVFLGIYVVTLMGNISIIVLIRRSHHLHTPMYIFLCHLAFVDIGYSSSVTPVMLMSFLRKETSLPVAGCVAQLCSVVTFGTAECFLLAAMAYDRYVAICSPLLYSTCMSPGVCIILVGMSYLGGCVNAWTFIGCLLRLSFCGPNKVNHFFCDYSPLLKLACSHDFTFEIIPAISSGSIIVATVCVIAISYIYILITILKMHSTKGRHKAFSTCTSHLTAVTLFYGTITFIYVMPKSSYSTDQNKVVSVFYTVVIPMLNPLIYSLRNKEIKGALKRELRIKIFS

SEQ ID NO: 59893 - protein, 311 aa, Homo sapiens; identical to SEQ ID NO: 59892
  Payload ID: 11872
  Gene Symbol: OR5P3
  Gene Name: olfactory receptor, family 5, subfamily P, member 3
  Uniprot ID: Q8WZ94
  ENSP ID: ENSP00000482237

SEQ ID NO: 59894 - protein, 311 aa, Homo sapiens; identical to SEQ ID NO: 59892
  Payload ID: 11872
  Gene Symbol: OR5P3
  Gene Name: olfactory receptor, family 5, subfamily P, member 3
  Uniprot ID: Q8WZ94
  ENSP ID: ENSP00000486070

SEQ ID NO: 59895 - protein, 324 aa, Homo sapiens; identical to SEQ ID NO: 59445
  Payload ID: 11873
  Gene Symbol: OR5R1
  Gene Name: olfactory receptor, family 5, subfamily R, member 1 (gene/pseudogene)
  Uniprot ID: Q8NH85
  ENSP ID: ENSP00000308595

SEQ ID NO: 59896 - protein, 326 aa, Homo sapiens
  Payload ID: 11874
  Gene Symbol: OR5T1
  Gene Name: olfactory receptor, family 5, subfamily T, member 1
  Uniprot ID: Q8NG75
  ENSP ID: ENSP00000323612
MSGLPSDMDLYKLQLNNFTEVTMFILISFTEEFDVQVFLFLLFLAIYLFTLIGNLGLVVPIIGDFWLHSPMYYFLGVLSFLDVCYSTVVTPKMLVNFLAKNKSISFLGCATQMFLACTFGTTECFLLAAMAYDRYVAIYNPLLYSVSMSPRVYVPLITASYVASILHATIHTVATFSLSFCGSNEIRHVFCNMPPLLAISCSDTHVIQLLFFYFVGSIEIVTILIVLISYGFILLAILKMQSAEGRRKVFSTCGAHLTGVTIYHGTILFMYVRPSSSYTSDNDMIVSIFYTIVIPMLNPIIYSLRNKDVKEAIKRLLVRNWFINKL

SEQ ID NO: 59897 - protein, 326 aa, Homo sapiens; identical to SEQ ID NO: 59896
  Payload ID: 11874
  Gene Symbol: OR5T1
  Gene Name: olfactory receptor, family 5, subfamily T, member 1
  Uniprot ID: Q8NG75
  ENSP ID: ENSP00000459132

SEQ ID NO: 59898 - protein, 359 aa, Homo sapiens
  Payload ID: 11875
  Gene Symbol: OR5T2
  Gene Name: olfactory receptor, family 5, subfamily T, member 2
  Uniprot ID: Q8NGG2
  ENSP ID: ENSP00000323688
MSYSIYKSTVNIPLSHGVVHSFCHNMNCNFMHIFKFVLDFNMKNVTEVTLFVLKGFTDNLELQTIFFFLFLAIYLFTLMGNLGLILVVIRDSQLHKPMYYFLSMLSSVDACYSSVITPNMLVDFTTKNKVISFLGCVAQVFLACSFGTTECFLLAAMAYDRYVAIYNPLLYSVSMSPRVYMPLINASYVAGILHATIHTVATFSLSFCGANEIRRVFCDIPPLLAISYSDTHTNQLLLFYFVGSIELVTILIVLISYGLILLAILKMYSAEGRRKVFSTCGAHLTGVSIYYGTILFMYVRPSSSYASDHDMIVSIFYTIVIPLLNPVIYSLRNKDVKDSMKKMFGKNQVINKVYFHTKK

SEQ ID NO: 59899 - protein, 359 aa, Homo sapiens; identical to SEQ ID NO: 59898
  Payload ID: 11875
  Gene Symbol: OR5T2
  Gene Name: olfactory receptor, family 5, subfamily T, member 2
  Uniprot ID: Q8NGG2
  ENSP ID: ENSP00000460931

SEQ ID NO: 59900 - protein, 340 aa, Homo sapiens
  Payload ID: 11876
  Gene Symbol: OR5T3
  Gene Name: olfactory receptor, family 5, subfamily T, member 3
  Uniprot ID: Q8NGG3
  ENSP ID: ENSP00000305403
MDSTFTGYNLYNLQVKTEMDKLSSGLDIYRNPLKNKTEVTMFILTGFTDDFELQVFLFLLFFAIYLFTLIGNLGLVVLVIEDSWLHNPMYYFLSVLSFLDACYSTVVTPKMLVNFLAKNKSISFIGCATQMLLFVTFGTTECFLLAAMAYDHYVAIYNPLLYSVSMSPRVYVPLITASYVAGILHATIHIVATFSLSFCGSNEIRHVFCDMPPLLAISCSDTHTNQLLLFYFVGSIEIVTILIVLISCDFILLSILKMHSAKGRQKAFSTCGSHLTGVTIYHGTILVSYMRPSSSYASDHDIIVSIFYTIVIPKLNPIIYSLRNKEVKKAVKKMLKLVYK

SEQ ID NO: 59901 - protein, 340 aa, Homo sapiens; identical to SEQ ID NO: 59900
  Payload ID: 11876
  Gene Symbol: OR5T3
  Gene Name: olfactory receptor, family 5, subfamily T, member 3
  Uniprot ID: Q8NGG3
  ENSP ID: ENSP00000459586

SEQ ID NO: 59902 - protein, 321 aa, Homo sapiens
  Payload ID: 11877
  Gene Symbol: OR5V1
  Gene Name: olfactory receptor, family 5, subfamily V, member 1
  Uniprot ID: Q9UGF6
  ENSP ID: ENSP00000230223
MERKNQTAITEFIILGFSNLNEWQFLLFTIFFLTYFCTLGGNILIILTTVTDPHLHTPMYYFLGNLAFIDICYTTSNVPQMMVHLLSKKKSISYVGCVVQLFAFVFFVGSECLLLAAMAYDRYIAICNPLRYSVILSKVLCNQLAASCWAAGFLNSVVHTVLTFCLPFCGNNQINYFFCDIPPLLILSCGNTSVNELALLSTGVFIGWTPFLCIVLSYICIISTILRIQSSEGRRKAFSTCASHLAIVFLFYGSAIFTYVRPISTYSLKKDRLVSVLYSVVTPMLNPIIYTLRNKDIKEAVKTIGSKWQPPISSLDSKLTY

SEQ ID NO: 59903 - protein, 321 aa, Homo sapiens
  Payload ID: 11877
  Gene Symbol: OR5V1
  Gene Name: olfactory receptor, family 5, subfamily V, member 1
  Uniprot ID: Q9UGF6
  ENSP ID: ENSP00000366359
MERKNQTAITEFIILGFSNLNELQFLLFTIFFLTYFCTLGGNILIILTTVTDPHLHTPMYYFLGNLAFIDICYTTSNVPQMMVHLLSKKKSISYVGCVVQLFAFVFFVGSECLLLAAMAYDRYIAICNPLRYSVILSKVLCNQLAASCWAAGFLNSVVHTVLTFCLPFCGNNQINYFFCDIPPLLILSCGNTSVNELALLSTGVFIGWTPFLCIVLSYICIISTILRIQSSEGRRKAFSTCASHLAIVFLFYGSAIFTYVRPISTYSLKKDRLVSVLYSVVTPMLNPIIYTLRNKDIKEAVKTIGSKWQPPISSLDSKLTY

SEQ ID NO: 59904 - protein, 321 aa, Homo sapiens; identical to SEQ ID NO: 59902
  Payload ID: 11877
  Gene Symbol: OR5V1
  Gene Name: olfactory receptor, family 5, subfamily V, member 1
  Uniprot ID: Q9UGF6
  ENSP ID: ENSP00000383534

SEQ ID NO: 59905 - protein, 321 aa, Homo sapiens; identical to SEQ ID NO: 59903
  Payload ID: 11877
  Gene Symbol: OR5V1
  Gene Name: olfactory receptor, family 5, subfamily V, member 1
  Uniprot ID: Q9UGF6
  ENSP ID: ENSP00000404109

SEQ ID NO: 59906 - protein, 321 aa, Homo sapiens; identical to SEQ ID NO: 59903
  Payload ID: 11877
  Gene Symbol: OR5V1
  Gene Name: olfactory receptor, family 5, subfamily V, member 1
  Uniprot ID: Q9UGF6
  ENSP ID: ENSP00000404163

SEQ ID NO: 59907 - protein, 321 aa, Homo sapiens; identical to SEQ ID NO: 59903
  Payload ID: 11877
  Gene Symbol: OR5V1
  Gene Name: olfactory receptor, family 5, subfamily V, member 1
  Uniprot ID: Q9UGF6
  ENSP ID: ENSP00000404990

SEQ ID NO: 59908 - protein, 321 aa, Homo sapiens; identical to SEQ ID NO: 59903
  Payload ID: 11877
  Gene Symbol: OR5V1
  Gene Name: olfactory receptor, family 5, subfamily V, member 1
  Uniprot ID: Q9UGF6
  ENSP ID: ENSP00000407363

SEQ ID NO: 59909 - protein, 321 aa, Homo sapiens
  Payload ID: 11877
  Gene Symbol: OR5V1
  Gene Name: olfactory receptor, family 5, subfamily V, member 1
  Uniprot ID: Q9UGF6
  ENSP ID: ENSP00000412591
MERKNQTAITEFIILGFSNLNELQFLLFTIFFLTYFCTLGGNILMILTTVTDPHLHTPMYYFLGNLAFIDICYTTSNVPQMMVHLLSKKKSISYVGCVVQLFAFVFFVGSECLLLAAMAYDRYIAICNPLRYSVILSKVLCNQLAASCWAAGFLNSVVHTVLTFCLPFCGNNQINYFFCDIPPLLILSCGNTSVNELALLSTGVFIGWTPFLCIVLSYICIISTILRIQSSEGRRKAFSTCASHLAIVFLFYGSAIFTYVRPISTYSLKKDRLVSVLYSVVTPMLNPIIYTLRNKDIKEAVKTIGSKWQPPISSLDSKLTY

SEQ ID NO: 59910 - protein, 321 aa, Homo sapiens; identical to SEQ ID NO: 59909
  Payload ID: 11877
  Gene Symbol: OR5V1
  Gene Name: olfactory receptor, family 5, subfamily V, member 1
  Uniprot ID: Q9UGF6
  ENSP ID: ENSP00000415545

SEQ ID NO: 59911 - protein, 321 aa, Homo sapiens; identical to SEQ ID NO: 59903
  Payload ID: 11877
  Gene Symbol: OR5V1
  Gene Name: olfactory receptor, family 5, subfamily V, member 1
  Uniprot ID: Q9UGF6
  ENSP ID: ENSP00000443309

SEQ ID NO: 59912 - protein, 321 aa, Homo sapiens; identical to SEQ ID NO: 59903
  Payload ID: 11877
  Gene Symbol: OR5V1
  Gene Name: olfactory receptor, family 5, subfamily V, member 1
  Uniprot ID: Q9UGF6
  ENSP ID: ENSP00000446579

SEQ ID NO: 59913 - protein, 321 aa, Homo sapiens; identical to SEQ ID NO: 59909
  Payload ID: 11877
  Gene Symbol: OR5V1
  Gene Name: olfactory receptor, family 5, subfamily V, member 1
  Uniprot ID: Q9UGF6
  ENSP ID: ENSP00000449041

SEQ ID NO: 59914 - protein, 321 aa, Homo sapiens; identical to SEQ ID NO: 59903
  Payload ID: 11877
  Gene Symbol: OR5V1
  Gene Name: olfactory receptor, family 5, subfamily V, member 1
  Uniprot ID: Q9UGF6
  ENSP ID: ENSP00000450230

SEQ ID NO: 59915 - protein, 310 aa, Homo sapiens
  Payload ID: 11878
  Gene Symbol: OR5W2
  Gene Name: olfactory receptor, family 5, subfamily W, member 2
  Uniprot ID: Q8NH69
  ENSP ID: ENSP00000342448
MDWENCSSLTDFFLLGITNNPEMKVTLFAVFLAVYIINFSANLGMIVLIRMDYQLHTPMYFFLSHLSFCDLCYSTATGPKMLVDLLAKNKSIPFYGCALQFLVFCIFADSECLLLSVMAFDRYKAIINPLLYTVNMSSRVCYLLLTGVYLVGIADALIHMTLAFRLCFCGSNEINHFFCDIPPLLLLSRSDTQVNELVLFTVFGFIELSTISGVFISYCYIILSVLEIHSAEGRFKALSTCTSHLSAVAIFQGTLLFMYFRPSSSYSLDQDKMTSLFYTLVVPMLNPLIYSLRNKDVKEALKKLKNKILF

SEQ ID NO: 59916 - protein, 313 aa, Homo sapiens
  Payload ID: 11879
  Gene Symbol: OR51A2
  Gene Name: olfactory receptor, family 51, subfamily A, member 2
  Uniprot ID: Q8NGJ7
  ENSP ID: ENSP00000369729
MSIINTSYVEITTFFLVGMPGLEYAHIWISIPICSMYLIAILGNGTILFIIKTEPSLHGPMYYFLSMLAMSDLGLSLSSLPTVLSIFLFNAPETSSSACFAQEFFIHGFSVLESSVLLIMSFDRFLAIHNPLRYTSILTTVRVAQIGIVFSFKSMLLVLPFPFTLRSLRYCKKNQLSHSYCLHQDVMKLACSDNRIDVIYGFFGALCLMVDFILIAVSYTLILKTVPGIASKKEELKALNTCVSHICAVIIFYLPIINLAVVHRFAGHVSPLINVLMANVLLLVPPLMKPIVYCVKTKQIRVRVVAKLCQWKI

SEQ ID NO: 59917 - protein, 313 aa, Homo sapiens
  Payload ID: 11880
  Gene Symbol: OR51A4
  Gene Name: olfactory receptor, family 51, subfamily A, member 4
  Uniprot ID: Q8NGJ6
  ENSP ID: ENSP00000369731
MSIINTSYVEITTFFLVGMPGLEYAHIWISIPICSMYLIAILGNGTILFIIKTEPSLHEPMYYFLSMLAMSDLGLSLSSLPTVLSIFLFNAPEISSNACFAQEFFIHGFSVLESSVLLIMSFDRFLAIHNPLRYTSILTTVRVAQIGIVFSFKSMLLVLPFPFTLRNLRYCKKNQLSHSYCLHQDVMKLACSDNRIDVIYGFFGALCLMVDFILIAVSYTLILKTVLGIASKKEQLKALNTCVSHICAVIIFYLPIINLAVVHRFARHVSPLINVLMANVLLLVPPLTNPIVYCVKTKQIRVRVVAKLCQRKI

SEQ ID NO: 59918 - protein, 312 aa, Homo sapiens
  Payload ID: 11881
  Gene Symbol: OR51A7
  Gene Name: olfactory receptor, family 51, subfamily A, member 7
  Uniprot ID: Q8NH64
  ENSP ID: ENSP00000352305
MSVLNNSEVKLFLLIGIPGLEHAHIWFSIPICLMYLLAIMGNCTILFIIKTEPSLHEPMYYFLAMLAVSDMGLSLSSLPTMLRVFLFNAMGISPNACFAQEFFIHGFTVMESSVLLIMSLDRFLAIHNPLRYSSILTSNRVAKMGLILAIRSILLVIPFPFTLRRLKYCQKNLLSHSYCLHQDTMKLACSDNKTNVIYGFFIALCTMLDLALIVLSYVLILKTILSIASLAERLKALNTCVSHICAVLTFYVPIITLAAMHHFAKHKSPLVVILIADMFLLVPPLMNPIVYCVKTRQIWEKILGKLLNVCGR

SEQ ID NO: 59919 - protein, 312 aa, Homo sapiens
  Payload ID: 11882
  Gene Symbol: OR51B2
  Gene Name: olfactory receptor, family 51, subfamily B, member 2 (gene/pseudogene)
  Uniprot ID: Q9Y5P1
  ENSP ID: ENSP00000327540
MWPNITAAPFLLTGFPGLEAAHHWISIPFFAVYVCILLGNGMLLYLIKHDHSLHEPMYYFLTMLAGTDLMVTLTTMPTVMGILWVNHREISSVGCFLQAYFIHSLSVVESGSLLAMAYDCFIAIRNPLRYASILTNTRVIALGVGVFLRGFVSILPVILRLFSFSYCKSHVITRAFCLHQEIMRLACADITFNRLYPVILISLTIFLDCLIILFSYILILNTVIGIASGEERAKALNTCISHISCVLIFYVTVMGLTFIYRFGKNVPEVVHIIMSYIYFLFPPLMNPVIYSIKTKQIQYGIIRLLSKHRFSS

SEQ ID NO: 59920 - protein, 312 aa, Homo sapiens; identical to SEQ ID NO: 59919
  Payload ID: 11882
  Gene Symbol: OR51B2
  Gene Name: olfactory receptor, family 51, subfamily B, member 2 (gene/pseudogene)
  Uniprot ID: Q9Y5P1
  ENSP ID: ENSP00000485407

SEQ ID NO: 59921 - protein, 312 aa, Homo sapiens; identical to SEQ ID NO: 59919
  Payload ID: 11882
  Gene Symbol: OR51B2
  Gene Name: olfactory receptor, family 51, subfamily B, member 2 (gene/pseudogene)
  Uniprot ID: Q9Y5P1
  ENSP ID: ENSP00000485415

SEQ ID NO: 59922 - protein, 310 aa, Homo sapiens
  Payload ID: 11883
  Gene Symbol: OR51B4
  Gene Name: olfactory receptor, family 51, subfamily B, member 4
  Uniprot ID: Q9Y5P0
  ENSP ID: ENSP00000369573
MWYNNSAGPFLLTGFLGSEAVHYRISMSFFVIYFSVLFGNGTLLVLIWNDHSLHEPMYYFLAMLADTDLGMTFTTMPTVLGVLLLDQREIAHAACFTQSFIHSLAIVESGILLVLAYDCFIAIRTPLRYNCILTNSRVMNIGLGVLMRGFMSILPIILSLYCYPYCGSRALLHTFCLHQDVIKLACADITFNHIYPIIQTSLTVFLDALIIIFSYILILKTVMGIASGQEEAKSLNTCVSHISCVLVFHITVMGLSFIHRFGKHAPHVVPITMSYVHFLFPPFVNPIIYSIKTKQIQRSIIRLFSGQSRA

SEQ ID NO: 59923 - protein, 312 aa, Homo sapiens
  Payload ID: 11884
  Gene Symbol: OR51B5
  Gene Name: olfactory receptor, family 51, subfamily B, member 5
  Uniprot ID: Q9H339
  ENSP ID: ENSP00000300773
MSSSGSSHPFLLTGFPGLEEAHHWISVFFLFMYISILFGNGTLLLLIKEDHNLHEPMYFFLAMLAATDLGLALTTMPTVLGVLWLDHREIGSAACFSQAYFIHSLSFLESGILLAMAYDRFIAICNPLRYTSVLTNTRVVKIGLGVLMRGFVSVVPPIRPLYFFLYCHSHVLSHAFCLHQDVIKLACADTTFNRLYPAVLVVFIFVLDYLIIFISYVLILKTVLSIASREERAKALITCVSHICCVLVFYVTVIGLSLIHRFGKQVPHIVHLIMSYAYFLFPPLMNPITYSVKTKQIQNAILHLFTTHRIGT

SEQ ID NO: 59924 - protein, 312 aa, Homo sapiens
  Payload ID: 11885
  Gene Symbol: OR51B6
  Gene Name: olfactory receptor, family 51, subfamily B, member 6
  Uniprot ID: Q9H340
  ENSP ID: ENSP00000369568
MGLNKSASTFQLTGFPGMEKAHHWIFIPLLAAYISILLGNGTLLFLIRNDHNLHEPMYYFLAMLAATDLGVTLTTMPTVLGVLWLDHREIGHGACFSQAYFIHTLSVMESGVLLAMAYDCFITIRSPLRYTSILTNTQVMKIGVRVLTRAGLSIMPIVVRLHWFPYCRSHVLSHAFCLHQDVIKLACADITFNRLYPVVVLFAMVLLDFLIIFFSYILILKTVMGIGSGGERAKALNTCVSHICCILVFYVTVVCLTFIHRFGKHVPHVVHITMSYIHFLFPPFMNPFIYSIKTKQIQSGILRLFSLPHSRA

SEQ ID NO: 59925 - protein, 324 aa, Homo sapiens
  Payload ID: 11886
  Gene Symbol: OR51D1
  Gene Name: olfactory receptor, family 51, subfamily D, member 1
  Uniprot ID: Q8NGF3
  ENSP ID: ENSP00000350222
MQKPQLLVPIIATSNGNLVHAAYFLLVGIPGLGPTIHFWLAFPLCFMYALATLGNLTIVLIIRVERRLHEPMYLFLAMLSTIDLVLSSITMPKMASLFLMGIQEIEFNICLAQMFLIHALSAVESAVLLAMAFDRFVAICHPLRHASVLTGCTVAKIGLSALTRGFVFFFPLPFILKWLSYCQTHTVTHSFCLHQDIMKLSCTDTRVNVVYGLFIILSVMGVDSLFIGFSYILILWAVLELSSRRAALKAFNTCISHLCAVLVFYVPLIGLSVVHRLGGPTSLLHVVMANTYLLLPPVVNPLVYGAKTKEICSRVLCMFSQGGK

SEQ ID NO: 59926 - protein, 318 aa, Homo sapiens
  Payload ID: 11887
  Gene Symbol: OR51E1
  Gene Name: olfactory receptor, family 51, subfamily E, member 1
  Uniprot ID: Q8TCB6
  ENSP ID: ENSP00000380155
MMVDPNGNESSATYFILIGLPGLEEAQFWLAFPLCSLYLIAVLGNLTIIYIVRTEHSLHEPMYIFLCMLSGIDILISTSSMPKMLAIFWFNSTTIQFDACLLQMFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRLFHVATHASEP

SEQ ID NO: 59927 - protein, 72 aa, Homo sapiens
  Payload ID: 11887
  Gene Symbol: OR51E1
  Gene Name: olfactory receptor, family 51, subfamily E, member 1
  ENSP ID: ENSP00000431593
MMVDPNGNESSATYFILIGLPGLEEAQFWLAFPLCSLYLIAVLASGVTLRCPSSWPISICWFLLCSTQLSME

SEQ ID NO: 59928 - protein, 320 aa, Homo sapiens
  Payload ID: 11888
  Gene Symbol: OR51E2
  Gene Name: olfactory receptor, family 51, subfamily E, member 2
  Uniprot ID: Q9H255
  ENSP ID: ENSP00000380153
MSSCNFTHATFVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKISCDKDLQAVGGK

SEQ ID NO: 59929 - protein, 83 aa, Homo sapiens
  Payload ID: 11888
  Gene Symbol: OR51E2
  Gene Name: olfactory receptor, family 51, subfamily E, member 2
  ENSP ID: ENSP00000432644
MSSCNFTHATFVLIGIPGLEKAHFWVGFPLLSMYVVAMFGNCIVVFIVRTERSLHAPMYLFLCMLAAIDLALSTSTMPKILAL

SEQ ID NO: 59930 - protein, 312 aa, Homo sapiens; identical to SEQ ID NO: 59438
  Payload ID: 11889
  Gene Symbol: OR51F1
  Gene Name: olfactory receptor, family 51, subfamily F, member 1 (gene/pseudogene)
  ENSP ID: ENSP00000345163

SEQ ID NO: 59931 - protein, 342 aa, Homo sapiens
  Payload ID: 11890
  Gene Symbol: OR51F2
  Gene Name: olfactory receptor, family 51, subfamily F, member 2
  Uniprot ID: Q8NH61
  ENSP ID: ENSP00000323952
MTETSLSSQCFPMSVLNNTIAEPLIFLLMGIPGLKATQYWISIPFCLLYVVAVSGNSMILFVVLCERSLHKPMYYFLSMLSATDLSLSLCTLSTTLGVFWFEAREINLNACIAQMFFLHGFTFMESGVLLAMAFDRFVAICYPLRYTTILTNARIAKIGMSMLIRNVAVMLPVMLFVKRLSFCSSMVLSHSYCYHVDLIQLSCTDNRINSILGLFALLSTTGFDCPCILLSYILIIRSVLSIASSEERRKAFNTCTSHISAVSIFYLPLISLSLVHRYGHSAPPFVHIIMANVFLLIPPVLNPIIYSVKIKQIQKAIIKVLIQKHSKSNHQLFLIRDKAIYE

SEQ ID NO: 59932 - protein, 321 aa, Homo sapiens
  Payload ID: 11891
  Gene Symbol: OR51G1
  Gene Name: olfactory receptor, family 51, subfamily G, member 1 (gene/pseudogene)
  Uniprot ID: Q8NGK1
  ENSP ID: ENSP00000322546
MTILLNSSLQRATFFLTGFQGLEGLHGWISIPFCFIYLTVILGNLTILHVICTDATLHGPMYYFLGMLAVTDLGLCLSTLPTVLGIFWFDTREIGIPACFTQLFFIHTLSSMESSVLLSMSIDRYVAVCNPLHDSTVLTPACIVKMGLSSVLRSALLILPLPFLLKRFQYCHSHVLAHAYCLHLEIMKLACSSIIVNHIYGLFVVACTVGVDSLLIFLSYALILRTVLSIASHQERLRALNTCVSHICAVLLFYIPMIGLSLVHRFGEHLPRVVHLFMSYVYLLVPPLMNPIIYSIKTKQIRQRIIKKFQFIKSLRCFWKD

SEQ ID NO: 59933 - protein, 314 aa, Homo sapiens
  Payload ID: 11892
  Gene Symbol: OR51G2
  Gene Name: olfactory receptor, family 51, subfamily G, member 2
  Uniprot ID: Q8NGK0
  ENSP ID: ENSP00000322593
MTLGSLGNSSSSVSATFLLSGIPGLERMHIWISIPLCFMYLVSIPGNCTILFIIKTERSLHEPMYLFLSMLALIDLGLSLCTLPTVLGIFWVGAREISHDACFAQLFFIHCFSFLESSVLLSMAFDRFVAICHPLHYVSILTNTVIGRIGLVSLGRSVALIFPLPFMLKRFPYCGSPVLSHSYCLHQEVMKLACADMKANSIYGMFVIVSTVGIDSLLILFSYALILRTVLSIASRAERFKALNTCVSHICAVLLFYTPMIGLSVIHRFGKQAPHLVQVVMGFMYLLFPPVMNPIVYSVKTKQIRDRVTHAFCY

SEQ ID NO: 59934 - protein, 302 aa, Homo sapiens
  Payload ID: 11893
  Gene Symbol: OR51H1
  Gene Name: olfactory receptor, family 51, subfamily H, member 1
  Uniprot ID: Q8NH63
  ENSP ID: ENSP00000322724
MTNLNASQANHRNFILTGIPGTPDKNPWLAFPLGFLYTLTLLGNGTILAVIKVEPSLHEPTYYFLSILALTDVSLSMSTLPSMLSIYWFNAPQIVFDACIMQMFFIHVFGIVESGVLVSMAFDRFVAIRNPLHYVSILTHDVIRKTGIAVLTRAVCVVFPVPFLIKCLPFCHSNVLSHSYCLHQNMMRLACASTRINSLYGLIVVIFTLGLDVLLTLLSYVLTLKTVLGIVSRGERLKTLSTCLSHMSTVLLFYVPFMGAASMIHRFWEHLSPVVHMVMADIYLLLPPVLNPIVYSVKTKQI

SEQ ID NO: 59935 - protein, 314 aa, Homo sapiens
  Payload ID: 11894
  Gene Symbol: OR51I1
  Gene Name: olfactory receptor, family 51, subfamily I, member 1
  Uniprot ID: Q9H343
  ENSP ID: ENSP00000369559
MLGLNGTPFQPATLQLTGIPGIQTGLTWVALIFCILYMISIVGNLSILTLVFWEPALHQPMYYFLSMLALNDLGVSFSTLPTVISTFCFNYNHVAFNACLVQMFFIHTFSFMESGILLAMSLDRFVAICYPLRYVTVLTHNRILAMGLGILTKSFTTLFPFPFVVKRLPFCKGNVLHHSYCLHPDLMKVACGDIHVNNIYGLLVIIFTYGMDSTFILLSYALILRAMLVIISQEQRLKALNTCMSHICAVLAFYVPIIAVSMIHRFWKSAPPVVHVMMSNVYLFVPPMLNPIIYSVKTKEIRKGILKFFHKSQA

SEQ ID NO: 59936 - protein, 312 aa, Homo sapiens
  Payload ID: 11895
  Gene Symbol: OR51I2
  Gene Name: olfactory receptor, family 51, subfamily I, member 2
  Uniprot ID: Q9H344
  ENSP ID: ENSP00000341987
MGLFNVTHPAFFLLTGIPGLESSHSWLSGPLCVMYAVALGGNTVILQAVRVEPSLHEPMYYFLSMLSFSDVAISMATLPTVLRTFCLNARNITFDACLIQMFLIHFFSMMESGILLAMSFDRYVAICDPLRYATVLTTEVIAAMGLGAAARSFITLFPLPFLIKRLPICRSNVLSHSYCLHPDMMRLACADISINSIYGLFVLVSTFGMDLFFIFLSYVLILRSVMATASREERLKALNTCVSHILAVLAFYVPMIGVSTVHRFGKHVPCYIHVLMSNVYLFVPPVLNPLIYSAKTKEIRRAIFRMFHHIKI

SEQ ID NO: 59937 - protein, 316 aa, Homo sapiens
  Payload ID: 11896
  Gene Symbol: OR51J1
  Gene Name: olfactory receptor, family 51, subfamily J, member 1 (gene/pseudogene)
  Uniprot ID: Q9H342
  ENSP ID: ENSP00000332473
MKISNNSLGFLPTTFILVGIPGLESEHLWISVPFSLIYIIIFLGNGIILHVIRTDIALHQPMYLFLAMLALAEVRVSASTLPTVLGIFLFGNTEISLEACLFPDVLHPFFIHDGASCAAGHVFGPLYSHLQPTELHSYPDTAQGLWHRSYYRTEKHYAHGSVAHSLMASALLWPQCPLTFLLSAPQSYLSCGNISVNNIYGIFIVTSTFGLDSLLIVISYGLILHTVLGIATGEGRKKALNTCGSHVCAVLAYYVPMIGLSIVHRLGHRVSPLLQAMMANAYLFFPPVVNPIVYSIKTKEIHGAIVRMLLEKRRRV

SEQ ID NO: 59938 - protein, 315 aa, Homo sapiens
  Payload ID: 11897
  Gene Symbol: OR51L1
  Gene Name: olfactory receptor, family 51, subfamily L, member 1
  Uniprot ID: Q8NGJ5
  ENSP ID: ENSP00000322156
MGDWNNSDAVEPIFILRGFPGLEYVHSWLSILFCLAYLVAFMGNVTILSVIWIESSLHQPMYYFISILAVNDLGMSLSTLPTMLAVLWLDAPEIQASACYAQLFFIHTFTFLESSVLLAMAFDRFVAICHPLHYPTILTNSVIGKIGLACLLRSLGVVLPTPLLLRHYHYCHGNALSHAFCLHQDVLRLSCTDARTNSIYGLCVVIATLGVDSIFILLSYVLILNTVLDIASREEQLKALNTCVSHICVVLIFFVPVIGVSMVHRFGKHLSPIVHILMADIYLLLPPVLNPIVYSVRTKQIRLGILHKFVLRRRF

SEQ ID NO: 59939 - protein, 326 aa, Homo sapiens
  Payload ID: 11898
  Gene Symbol: OR51M1
  Gene Name: olfactory receptor, family 51, subfamily M, member 1
  Uniprot ID: Q9H341
  ENSP ID: ENSP00000333196
MSVQYSLSPQFMLLSNITQFSPIFYLTSFPGLEGIKHWIFIPFFFMYMVAISGNCFILIIIKTNPRLHTPMYYLLSLLALTDLGLCVSTLPTTMGIFWFNSHSIYFGACQIQMFCIHSFSFMESSVLLMMSFDRLVAICHPLRYSVIITGQQVVRAGLIVIFRGPVATIPIVLLLKAFPYCGSVVLSHSFCLHQEVIQLACTDITFNNLYGLMVVVFTVMLDLVLIALSYGLILHTVAGLASQEEQRRAFQTCTAPLCAVLVFFVPMMGLSLVHRFGKHAPPAIHLLMANVYLFVPPMLNPIIYSIKTKEIHRAIIKFLGLKKASK

SEQ ID NO: 59940 - protein, 317 aa, Homo sapiens
  Payload ID: 11899
  Gene Symbol: OR51Q1
  Gene Name: olfactory receptor, family 51, subfamily Q, member 1 (gene/pseudogene)
  Uniprot ID: Q8NH59
  ENSP ID: ENSP00000300778
MSQVTNTTQEGIYFILTDIPGFEASHIWISIPVCCLYTISIMGNTTILTVIRTEPSVHQRMYLFLSMLALTDLGLTLTTLPTVMQLLWFNVRRISSEACFAQFFFLHGFSFMESSVLLAMSVDCYVAICCPLHYASILTNEVIGRTGLAIICCCVLAVLPSLFLLKRLPFCHSHLLSRSYCLHQDMIRLVCADIRLNSWYGFALALLIIIVDPLLIVISYTLILKNILGTATWAERLRALNNCLSHILAVLVLYIPMVGVSMTHRFAKHASPLVHVIMANIYLLAPPVMNPIIYSVKNKQIQWGMLNFLSLKNMHSR

SEQ ID NO: 59941 - protein, 323 aa, Homo sapiens
  Payload ID: 11900
  Gene Symbol: OR51S1
  Gene Name: olfactory receptor, family 51, subfamily S, member 1
  Uniprot ID: Q8NGJ8
  ENSP ID: ENSP00000322754
MSTLPTQIAPNSSTSMAPTFLLVGMPGLSGAPSWWTLPLIAVYLLSALGNGTILWIIALQPALHRPMHFFLFLLSVSDIGLVTALMPTLLGIALAGAHTVPASACLLQMVFIHVFSVMESSVLLAMSIDRALAICRPLHYPALLTNGVISKISLAISFRCLGLHLPLPFLLAYMPYCLPQVLTHSYCLHPDVARLACPEAWGAAYSLFVVLSAMGLDPLLIFFSYGLIGKVLQGVESREDRWKAGQTCAAHLSAVLLFYIPMILLALINHPELPITQHTHTLLSYVHFLLPPLINPILYSVKMKEIRKRILNRLQPRKVGGAQ

SEQ ID NO: 59942 - protein, 327 aa, Homo sapiens
  Payload ID: 11901
  Gene Symbol: OR51T1
  Gene Name: olfactory receptor, family 51, subfamily T, member 1
  Uniprot ID: Q8NGJ9
  ENSP ID: ENSP00000322679
MAIFNNTTSSSSNFLLTAFPGLECAHVWISIPVCCLYTIALLGNSMIFLVIITKRRLHKPMYYFLSMLAAVDLCLTITTLPTVLGVLWFHAREISFKACFIQMFFVHAFSLLESSVLVAMAFDRFVAICNPLNYATILTDRMVLVIGLVICIRPAVFLLPLLVAINTVSFHGGHELSHPFCYHPEVIKYTYSKPWISSFWGLFLQLYLNGTDVLFILFSYVLILRTVLGIVARKKQQKALSTCVCHICAVTIFYVPLISLSLAHRLFHSTPRVLCSTLANIYLLLPPVLNPIIYSLKTKTIRQAMFQLLQSKGSWGFNVRGLRGRWD

SEQ ID NO: 59943 - protein, 354 aa, Homo sapiens
  Payload ID: 11901
  Gene Symbol: OR51T1
  Gene Name: olfactory receptor, family 51, subfamily T, member 1
  ENSP ID: ENSP00000369738
MTNKMYAIYIKNLNYFSFLIVQCLQPTMAIFNNTTSSSSNFLLTAFPGLECAHVWISIPVCCLYTIALLGNSMIFLVIITKRRLHKPMYYFLSMLAAVDLCLTITTLPTVLGVLWFHAREISFKACFIQMFFVHAFSLLESSVLVAMAFDRFVAICNPLNYATILTDRMVLVIGLVICIRPAVFLLPLLVAINTVSFHGGHELSHPFCYHPEVIKYTYSKPWISSFWGLFLQLYLNGTDVLFILFSYVLILRTVLGIVARKKQQKALSTCVCHICAVTIFYVPLISLSLAHRLFHSTPRVLCSTLANIYLLLPPVLNPIIYSLKTKTIRQAMFQLLQSKGSWGFNVRGLRGRWD

SEQ ID NO: 59944 - protein, 321 aa, Homo sapiens
  Payload ID: 11902
  Gene Symbol: OR51V1
  Gene Name: olfactory receptor, family 51, subfamily V, member 1
  Uniprot ID: Q9H2C8
  ENSP ID: ENSP00000321729
MFLSSRMITSVSPSTSTNSSFLLTGFSGMEQQYPWLSIPFSSIYAMVLLGNCMVLHVIWTEPSLHQPMFYFLSMLALTDLCMGLSTVYTVLGILWGIIREISLDSCIAQSYFIHGLSFMESSVLLTMAFDRYIAICNPLRYSSILTNSRIIKIGLTIIGRSFFFITPPIICLKFFNYCHFHILSHSFCLHQDLLRLACSDIRFNSYYALMLVICILLLDAILILFSYILILKSVLAVASQEERHKLFQTCISHICAVLVFYIPIISLTMVHRFGKHLSPVAHVLIGNIYILFPPLMNPIIYSVKTQQIHTRMLRLFSLKRY

SEQ ID NO: 59945 - protein, 312 aa, Homo sapiens
  Payload ID: 11903
  Gene Symbol: OR52A1
  Gene Name: olfactory receptor, family 52, subfamily A, member 1
  Uniprot ID: Q9UKL2
  ENSP ID: ENSP00000333684
MSISNITVYMPSVLTLVGIPGLESVQCWIGIPFCAIYLIAMIGNSLLLSIIKSERSLHEPLYIFLGMLGATDIALASSIMPKMLGIFWFNVPEIYFDSCLLQMWFIHTLQGIESGILVAMALDRYVAICYPLRHANIFTHQLVIQIGTMVVLRAAILVAPCLVLIKCRFQFYHTTVISHSYCEHMAIVKLAAANVQVNKIYGLFVAFTVAGFDLTFITLSYIQIFITVFRLPQKEARFKAFNTCIAHICVFLQFYLLAFFSFFTHRFGSHISPYIHILFSSIYLLVPPFLNPLVYGAKTTQIRIHVVKMFCS

SEQ ID NO: 59946 - protein, 312 aa, Homo sapiens; identical to SEQ ID NO: 59945
  Payload ID: 11903
  Gene Symbol: OR52A1
  Gene Name: olfactory receptor, family 52, subfamily A, member 1
  Uniprot ID: Q9UKL2
  ENSP ID: ENSP00000369725

SEQ ID NO: 59947 - protein, 316 aa, Homo sapiens
  Payload ID: 11904
  Gene Symbol: OR52A5
  Gene Name: olfactory receptor, family 52, subfamily A, member 5
  Uniprot ID: Q9H2C5
  ENSP ID: ENSP00000303469
MPTFNGSVFMPSAFILIGIPGLESVQCWIGIPFSAMYLIGVIGNSLILVIIKYENSLHIPMYIFLAMLAATDIALNTCILPKMLGIFWFHLPEISFDACLFQMWLIHSFQAIESGILLAMALDRYVAICIPLRHATIFSQQFLTHIGLGVTLRAAILIIPSLGLIKCCLKHYRTTVISHSYCEHMAIVKLATEDIRVNKIYGLFVAFAILGFDIIFITLSYVQIFITVFQLPQKEARFKAFNTCIAHICVFLQFYLLAFFSFFTHRFGSHIPPYIHILLSNLYLLVPPFLNPIVYGVKTKQIRDHIVKVFFFKKVT

SEQ ID NO: 59948 - protein, 323 aa, Homo sapiens
  Payload ID: 11905
  Gene Symbol: OR52B2
  Gene Name: olfactory receptor, family 52, subfamily B, member 2
  Uniprot ID: Q96RD2
  ENSP ID: ENSP00000432011
MSHTNVTIFHPAVFVLPGIPGLEAYHIWLSIPLCLIYITAVLGNSILIVVIVMERNLHVPMYFFLSMLAVMDILLSTTTVPKALAIFWLQAHNIAFDACVTQGFFVHMMFVGESAILLAMAFDRFVAICAPLRYTTVLTWPVVGRIALAVITRSFCIIFPVIFLLKRLPFCLTNIVPHSYCEHIGVARLACADITVNIWYGFSVPIVMVILDVILIAVSYSLILRAVFRLPSQDARHKALSTCGSHLCVILMFYVPSFFTLLTHHFGRNIPQHVHILLANLYVAVPPMLNPIVYGVKTKQIREGVAHRFFDIKTWCCTSPLGS

SEQ ID NO: 59949 - protein, 314 aa, Homo sapiens; identical to SEQ ID NO: 1014
  Payload ID: 11906
  Gene Symbol: OR52B4
  Gene Name: olfactory receptor, family 52, subfamily B, member 4 (gene/pseudogene)
  Uniprot ID: Q8NGK2
  ENSP ID: ENSP00000386160

SEQ ID NO: 59950 - protein, 314 aa, Homo sapiens; identical to SEQ ID NO: 1014
  Payload ID: 11906
  Gene Symbol: OR52B4
  Gene Name: olfactory receptor, family 52, subfamily B, member 4 (gene/pseudogene)
  Uniprot ID: Q8NGK2
  ENSP ID: ENSP00000485530

SEQ ID NO: 59951 - protein, 335 aa, Homo sapiens
  Payload ID: 11907
  Gene Symbol: OR52B6
  Gene Name: olfactory receptor, family 52, subfamily B, member 6
  Uniprot ID: Q8NGF0
  ENSP ID: ENSP00000341581
MAQVRALHKIMALFSANSIGAMNNSDTRIAGCFLTGIPGLEQLHIWLSIPFCIMYITALEGNGILICVILSQAILHEPMYIFLSMLASADVLLSTTTMPKALANLWLGYSLISFDGCLTQMFFIHFLFIHSAVLLAMAFDRYVAICSPLRYVTILTSKVIGKIVTAALSHSFIIMFPSIFLLEHLHYCQINIIAHTFCEHMGIAHLSCSDISINVWYGLAAALLSTGLDIMLITVSYIHILQAVFRLLSQDARSKALSTCGSHICVILLFYVPALFSVFAYRFGGRSVPCYVHILLASLYVVIPPMLNPVIYGVRTKPILEGAKQMFSNLAKGSK

SEQ ID NO: 59952 - protein, 318 aa, Homo sapiens
  Payload ID: 11908
  Gene Symbol: OR52D1
  Gene Name: olfactory receptor, family 52, subfamily D, member 1
  Uniprot ID: Q9H346
  ENSP ID: ENSP00000326232
MSDSNLSDNHLPDTFFLTGIPGLEAAHFWIAIPFCAMYLVALVGNAALILVIAMDNALHAPMYLFLCLLSLTDLALSSTTVPKMLAILWLHAGEISFGGCLAQMFCVHSIYALESSILLAMAFDRYVAICNPLRYTTILNHAVIGRIGFVGLFRSVAIVSPFIFLLRRLPYCGHRVMTHTYCEHMGIARLACANITVNIVYGLTVALLAMGLDSILIAISYGFILHAVFHLPSHDAQHKALSTCGSHIGIILVFYIPAFFSFLTHRFGHHEVPKHVHIFLANLYVLVPPVLNPILYGARTKEIRSRLLKLLHLGKTSI

SEQ ID NO: 59953 - protein, 325 aa, Homo sapiens
  Payload ID: 11909
  Gene Symbol: OR52E2
  Gene Name: olfactory receptor, family 52, subfamily E, member 2
  Uniprot ID: Q8NGJ4
  ENSP ID: ENSP00000322088
MFLPNDTQFHPSSFLLLGIPGLETLHIWIGFPFCAVYMIALIGNFTILLVIKTDSSLHQPMFYFLAMLATTDVGLSTATIPKMLGIFWINLRGIIFEACLTQMFFIHNFTLMESAVLVAMAYDSYVAICNPLQYSAILTNKVVSVIGLGVFVRALIFVIPSILLILRLPFCGNHVIPHTYCEHMGLAHLSCASIKINIIYGLCAICNLVFDITVIALSYVHILCAVFRLPTHEARLKSLSTCGSHVCVILAFYTPALFSFMTHRFGRNVPRYIHILLANLYVVVPPMLNPVIYGVRTKQIYKCVKKILLQEQGMEKEEYLIHTRF

SEQ ID NO: 59954 - protein, 312 aa, Homo sapiens
  Payload ID: 11910
  Gene Symbol: OR52E4
  Gene Name: olfactory receptor, family 52, subfamily E, member 4
  Uniprot ID: Q8NGH9
  ENSP ID: ENSP00000321426
MPSINDTHFYPPFFLLLGIPGLDTLHIWISFPFCIVYLIAIVGNMTILFVIKTEHSLHQPMFYFLAMLSMIDLGLSTSTIPKMLGIFWFNLQEISFGGCLLQMFFIHMFTGMETVLLVVMAYDRFVAICNPLQYTMILTNKTISILASVVVGRNLVLVTPFVFLILRLPFCGHNIVPHTYCEHRGLAGLACAPIKINIIYGLMVISYIIVDVILIASSYVLILRAVFRLPSQDVRLKAFNTCGSHVCVMLCFYTPAFFSFMTHRFGQNIPHYIHILLANLYVVVPPALNPVIYGVRTKQIREQIVKIFVQKE

SEQ ID NO: 59955 - protein, 327 aa, Homo sapiens
  Payload ID: 11911
  Gene Symbol: OR52E5
  Gene Name: olfactory receptor, family 52, subfamily E, member 5
  Uniprot ID: Q8NH55
  ENSP ID: ENSP00000480583
MLHTNNTQFHPSTFLVVGVPGLEDVHVWIGFPFFAVYLTALLGNIIILFVIQTEQSLHQPMFYFLAMLAGTDLGLSTATIPKMLGIFWFNLGEIAFGACITQMYTIHICTGLESVVLTVTGIDRYIAICNPLRYSMILTNKVIAILGIVIIVRTLVFVTPFTFLILRLPFCGVRIIPHTYCEHMGLAKLACASINVIYGLIAFSVGYIDISVIGFSYVQILRAVFHLPAWDARPKALSTCGSHVCVMLAFYLPALFSFMTHRFGHNIPHYIHILLANLYVVFPPALNSVIYGVKTKQIREQVLRILNPKSFWHFDPKRIFHNNSVRQ

SEQ ID NO: 59956 - protein, 313 aa, Homo sapiens
  Payload ID: 11912
  Gene Symbol: OR52E6
  Gene Name: olfactory receptor, family 52, subfamily E, member 6
  Uniprot ID: Q96RD3
  ENSP ID: ENSP00000328878
MPIANDTQFHTSSFLLLGIPGLEDVHIWIGFPFFSVYLIALLGNAAIFFVIQTEQSLHEPMYYCLAMLDSIDLSLSTATIPKMLGIFWFNIKEISFGGYLSQMFFIHFFTVMESIVLVAMAFDRYIAICKPLWYTMILTSKIISLIAGIAVLRSLYMVIPLVFLLLRLPFCGHRIIPHTYCEHMGIARLACASIKVNIMFGLGSISLLLLDVLLIILSHIRILYAVFCLPSWEARLKALNTCGSHIGVILAFSTPAFFSFFTHCFGHDIPQYIHIFLANLYVVVPPTLNPVIYGVRTKHIRETVLRIFFKTDH

SEQ ID NO: 59957 - protein, 317 aa, Homo sapiens
  Payload ID: 11912
  Gene Symbol: OR52E6
  Gene Name: olfactory receptor, family 52, subfamily E, member 6
  ENSP ID: ENSP00000369279
MEKRMPIANDTQFHTSSFLLLGIPGLEDVHIWIGFPFFSVYLIALLGNAAIFFVIQTEQSLHEPMYYCLAMLDSIDLSLSTATIPKMLGIFWFNIKEISFGGYLSQMFFIHFFTVMESIVLVAMAFDRYIAICKPLWYTMILTSKIISLIAGIAVLRSLYMVIPLVFLLLRLPFCGHRIIPHTYCEHMGIARLACASIKVNIMFGLGSISLLLLDVLLIILSHIRILYAVFCLPSWEARLKALNTCGSHIGVILAFSTPAFFSFFTHCFGHDIPQYIHIFLANLYVVVPPTLNPVIYGVRTKHIRETVLRIFFKTDH

SEQ ID NO: 59958 - protein, 317 aa, Homo sapiens
  Payload ID: 11913
  Gene Symbol: OR52E8
  Gene Name: olfactory receptor, family 52, subfamily E, member 8
  Uniprot ID: Q6IFG1
  ENSP ID: ENSP00000444054
MAGRMSTSNHTQFHPSSFLLLGIPGLEDVHIWIGVPFFFVYLVALLGNTALLFVIQTEQSLHEPMYYFLAMLDSIDLGLSTATIPKMLGIFWFNTKEISFGGCLSHMFFIHFFTAMESIVLVAMAFDRYIAICKPLRYTMILTSKIISLIAGIAVLRSLYMVVPLVFLLLRLPFCGHRIIPHTYCEHMGIARLACASIKVNIRFGLGNISLLLLDVILIILSYVRILYAVFCLPSWEARLKALNTCGSHIGVILAFFTPAFFSFLTHRFGHNIPQYIHIILANLYVVVPPALNPVIYGVRTKQIRERVLRIFLKTNH

SEQ ID NO: 59959 - protein, 320 aa, Homo sapiens
  Payload ID: 11914
  Gene Symbol: OR52H1
  Gene Name: olfactory receptor, family 52, subfamily H, member 1
  Uniprot ID: Q8NGJ2
  ENSP ID: ENSP00000326259
MPSASAMIIFNLSSYNPGPFILVGIPGLEQFHVWIGIPFCIIYIVAVVGNCILLYLIVVEHSLHEPMFFFLSMLAMTDLILSTAGVPKALSIFWLGAREITFPGCLTQMFFLHYNFVLDSAILMAMAFDHYVAICSPLRYTTILTPKTIIKSAMGISFRSFCIILPDVFLLTCLPFCRTRIIPHTYCEHIGVAQLACADISINFWYGFCVPIMTVISDVILIAVSYAHILCAVFGLPSQDACQKALGTCGSHVCVILMFYTPAFFSILAHRFGHNVSRTFHIMFANLYIVIPPALNPMVYGVKTKQIRDKVILLFSKGTG

SEQ ID NO: 59960 - protein, 349 aa, Homo sapiens [sequence omitted]

SEQ ID NO: 59961 - protein, 324 aa, Homo sapiens
  Payload ID: 11915
  Gene Symbol: OR52I1
  Gene Name: olfactory receptor, family 52, subfamily I, member 1
  Uniprot ID: Q8NGK6
  ENSP ID: ENSP00000436453
MLGPAYNHTMETPASFLLVGIPGLQSSHLWLAISLSAMYITALLGNTLIVTAIWMDSTRHEPMYCFLCVLAAVDIVMASSVVPKMVSIFCSGDSSISFSACFTQMFFVHLATAVETGLLLTMAFDRYVAICKPLHYKRILTPQVMLGMSMAVTIRAVTFMTPLSWMMNHLPFCGSNVVVHSYCKHIALARLACADPVPSSLYSLIGSSLMVGSDVAFIAASYILILRAVFDLSSKTAQLKALSTCGSHVGVMALYYLPGMASIYAAWLGQDIVPLHTQVLLADLYVIIPATLNPIIYGMRTKQLLEGIWSYLMHFLFDHSNLGS

SEQ ID NO: 59962 - protein, 350 aa, Homo sapiens
  Payload ID: 11916
  Gene Symbol: OR52I2
  Gene Name: olfactory receptor, family 52, subfamily I, member 2
  Uniprot ID: Q8NH67
  ENSP ID: ENSP00000308764
MCQQILRDCILLIHHLCINRKKVSLVMLGPAYNHTMETPASFLLVGIPGLQSSHLWLAISLSAMYIIALLGNTIIVTAIWMDSTRHEPMYCFLCVLAAVDIVMASSVVPKMVSIFCSGDSSISFSACFTQMFFVHLATAVETGLLLTMAFDRYVAICKPLHYKRILTPQVMLGMSMAITIRAIIAITPLSWMVSHLPFCGSNVVVHSYCEHIALARLACADPVPSSLYSLIGSSLMVGSDVAFIAASYILILKAVFGLSSKTAQLKALSTCGSHVGVMALYYLPGMASIYAAWLGQDVVPLHTQVLLADLYVIIPATLNPIIYGMRTKQLRERIWSYLMHVLFDHSNLGS

SEQ ID NO: 59963 - protein, 311 aa, Homo sapiens
  Payload ID: 11917
  Gene Symbol: OR52J3
  Gene Name: olfactory receptor, family 52, subfamily J, member 3
  Uniprot ID: Q8NH60
  ENSP ID: ENSP00000369728
MFYHNKSIFHPVTFFLIGIPGLEDFHMWISGPFCSVYLVALLGNATILLVIKVEQTLREPMFYFLAILSTIDLALSTTSVPRMLGIFWFDAHEINYGACVAQMFLIHAFTGMEAEVLLAMAFDRYVAVCAPLHYATILTSQVLVGISMCIVIRPVLLTLPMVYLIYRLPFCQAHIIAHSYCEHMGIAKLSCGNIRINGIYGLFVVSFFVLNLVLIGISYVYILRAVFRLPSHDAQLKALSTCGAHVGVICVFYIPSVFSFLTHRFGHQIPGYIHILVANLYLIIPPSLNPIIYGVRTKQIRERVLYVFTKK

SEQ ID NO: 59964 - protein, 314 aa, Homo sapiens
  Payload ID: 11918
  Gene Symbol: OR52K1
  Gene Name: olfactory receptor, family 52, subfamily K, member 1
  Uniprot ID: Q8NGK4
  ENSP ID: ENSP00000302422
MLPSNITSTHPAVFLLVGIPGLEHLHAWISIPFCFAYTLALLGNCTLLFIIQADAALHEPMYLFLAMLATIDLVLSSTTLPKMLAIFWFRDQEINFFACLVQMFFLHSFSIMESAVLLAMAFDRYVAICKPLHYTTVLTGSLITKIGMAAVARAVTLMTPLPFLLRRFHYCRGPVIAHCYCEHMAVVRLACGDTSFNNIYGIAVAMFIVVLDLLFVILSYVFILQAVLQLASQEARYKAFGTCVSHIGAILSTYTPVVISSVMHRVARHAAPRVHILLAIFYLLFPPMVNPIIYGVKTKQIREYVLSLFQRKNM

SEQ ID NO: 59965 - protein, 314 aa, Homo sapiens
  Payload ID: 11919
  Gene Symbol: OR52K2
  Gene Name: olfactory receptor, family 52, subfamily K, member 2
  Uniprot ID: Q8NGK3
  ENSP ID: ENSP00000318956
MSASNITLTHPTAFLLVGIPGLEHLHIWISIPFCLAYTLALLGNCTLLLIIQADAALHEPMYLFLAMLAAIDLVLSSSALPKMLAIFWFRDREINFFACLAQMFFLHSFSIMESAVLLAMAFDRYVAICKPLHYTKVLTGSLITKIGMAAVARAVTLMTPLPFLLRCFHYCRGPVIAHCYCEHMAVVRLACGDTSFNNIYGIAVAMFIVVLDLLLVILSYIFILQAVLLLASQEARYKAFGTCVSHIGAILAFYTTVVISSVMHRVARHAAPHVHILLANFYLLFPPMVNPIIYGVKTKQIRESILGVFPRKDM

SEQ ID NO: 59966 - protein, 329 aa, Homo sapiens
  Payload ID: 11920
  Gene Symbol: OR52L1
  Gene Name: olfactory receptor, family 52, subfamily L, member 1
  Uniprot ID: Q8NGH7
  ENSP ID: ENSP00000330338
MTLVSFFSFLSKPLIMLLSNSSWRLSQPSFLLVGIPGLEESQHWIALPLGILYLLALVGNVTILFIIWMDPSLHQSMYLFLSMLAAIDLVLASSTAPKALAVLLVHAHEIGYIVCLIQMFFIHAFSSMESGVLVAMALDRYVAICHPLHHSTILHPGVIGRIGMVVLVRGLLLLIPFPILLGTLIFCQATIIGHAYCEHMAVVKLACSETTVNRAYGLTMALLVIGLDVLAIGVSYAHILQAVLKVPGSEARLKAFSTCGSHICVILVFYVPGIFSFLTHRFGHHVPHHVHVLLATRYLLMPPALNPLVYGVKTQQIRQRVLRVFTQKD

SEQ ID NO: 59967 - protein, 317 aa, Homo sapiens
  Payload ID: 11921
  Gene Symbol: OR52M1
  Gene Name: olfactory receptor, family 52, subfamily M, member 1
  Uniprot ID: Q8NGK5
  ENSP ID: ENSP00000353343
MLTFHNVCSVPSSFWLTGIPGLESLHVWLSIPFGSMYLVAVVGNVTILAVVKIERSLHQPMYFFLCMLAAIDLVLSTSTIPKLLGIFWFGACDIGLDACLGQMFLIHCFATVESGIFLAMAFDRYVAICNPLRHSMVLTYTVVGRLGLVSLLRGVLYIGPLPLMIRLRLPLYKTHVISHSYCEHMAVVALTCGDSRVNNVYGLSIGFLVLILDSVAIAASYVMIFRAVMGLATPEARLKTLGTCASHLCAILIFYVPIAVSSLIHRFGQCVPPPVHTLLANFYLLIPPILNPIVYAVRTKQIRESLLQIPRIEMKIR

SEQ ID NO: 59968 - protein, 320 aa, Homo sapiens
  Payload ID: 11922
  Gene Symbol: OR52N1
  Gene Name: olfactory receptor, family 52, subfamily N, member 1
  Uniprot ID: Q8NH53
  ENSP ID: ENSP00000322823
MSFLNGTSLTPASFILNGIPGLEDVHLWISFPLCTMYSIAITGNFGLMYLIYCDEALHRPMYVFLALLSFTDVLMCTSTLPNTLFILWFNLKEIDFKACLAQMFFVHTFTGMESGVLMLMALDHCVAICFPLRYATILTNSVIAKAGFLTFLRGVMLVIPSTFLTKRLPYCKGNVIPHTYCDHMSVAKISCGNVRVNAIYGLIVALLIGGFDILCITISYTMILQAVVSLSSADARQKAFSTCTAHFCAIVLTYVPAFFTFFTHHFGGHTIPLHIHIIMANLYLLMPPTMNPIVYGVKTRQVRESVIRFFLKGKDNSHNF

SEQ ID NO: 59969 - protein, 321 aa, Homo sapiens
  Payload ID: 11923
  Gene Symbol: OR52N2
  Gene Name: olfactory receptor, family 52, subfamily N, member 2
  Uniprot ID: Q8NGI0
  ENSP ID: ENSP00000322801
MSGDNSSSLTPGFFILNGVPGLEATHIWISLPFCFMYIIAVVGNCGLICLISHEEALHRPMYYFLALLSFTDVTLCTTMVPNMLCIFWFNLKEIDFNACLAQMFFVHMLTGMESGVLMLMALDRYVAICYPLRYATILTNPVIAKAGLATFLRNVMLIIPFTLLTKRLPYCRGNFIPHTYCDHMSVAKVSCGNFKVNAIYGLMVALLIGVFDICCISVSYTMILQAVMSLSSADARHKAFSTCTSHMCSIVITYVAAFFTFFTHRFVGHNIPNHIHIIVANLYLLLPPTMNPIVYGVKTKQIQEGVIKFLLGDKVSFTYDK

SEQ ID NO: 59970 - protein, 321 aa, Homo sapiens
  Payload ID: 11924
  Gene Symbol: OR52N4
  Gene Name: olfactory receptor, family 52, subfamily N, member 4 (gene/pseudogene)
  Uniprot ID: Q8NGI2
  ENSP ID: ENSP00000323224
MLTLNKTDLIPASFILNGVPGLEDTQLWISFPFCSMYVVAMVGNCGLLYLIHYEDALHKPMYYFLAMLSFTDLVMCSSTIPKALCIFWFHLKDIGFDECLVQMFFTHTFTGMESGVLMLMALDRYVAICYPLRYSTILTNPVIAKVGTATFLRGVLLIIPFTFLTKLLPYCRGNILPHTYCDHMSVAKLSCGNVKVNAIYGLMVALLIWGFDILCITNSYTMILRAVVSLSSADARQKAFNTCTAHICAIVFSYTPAFFSFFSHRFGEHIIPPSCHIIVANIYLLLPPTMNPIVYGVKTKQIRDCVIRILSGSKDTKSYSM

SEQ ID NO: 59971 - protein, 324 aa, Homo sapiens
  Payload ID: 11925
  Gene Symbol: OR52N5
  Gene Name: olfactory receptor, family 52, subfamily N, member 5
  Uniprot ID: Q8NH56
  ENSP ID: ENSP00000322866
MPLFNSLCWFPTIHVTPPSFILNGIPGLERVHVWISLPLCTMYIIFLVGNLGLVYLIYYEESLHHPMYFFFGHALSLIDLLTCTTTLPNALCIFWFSLKEINFNACLAQMFFVHGFTGVESGVLMLMALDRYVAICYPLRYATTLTNPIIAKAELATFLRGVLLMIPFPFLVKRLPFCQSNIISHTYCDHMSVVKLSCASIKVNVIYGLMVALLIGVFDICCISLSYTLILKAAISLSSSDARQKAFSTCTAHISAIIITYVPAFFTFFAHRFGGHTIPPSLHIIVANLYLLLPPTLNPIVYGVKTKQIRKSVIKFFQGDKGAG

SEQ ID NO: 59972 - protein, 315 aa, Homo sapiens; identical to SEQ ID NO: 59439
  Payload ID: 11926
  Gene Symbol: OR52R1
  Gene Name: olfactory receptor, family 52, subfamily R, member 1 (gene/pseudogene)
  Uniprot ID: Q8NGF1
  ENSP ID: ENSP00000348368

SEQ ID NO: 59973 - protein, 320 aa, Homo sapiens
  Payload ID: 11927
  Gene Symbol: OR52W1
  Gene Name: olfactory receptor, family 52, subfamily W, member 1
  Uniprot ID: Q6IF63
  ENSP ID: ENSP00000309673
MAETLQLNSTFLHPNFFILTGFPGLGSAQTWLTLVFGPIYLLALLGNGALPAVVWIDSTLHQPMFLLLAILAATDLGLATSIAPGLLAVLWLGPRSVPYAVCLVQMFFVHALTAMESGVLLAMACDRAAAIGRPLHYPVLVTKACVGYAALALALKAVAIVVPFPLLVAKFEHFQAKTIGHTYCAHMAVVELVVGNTQATNLYGLALSLAISGMDILGITGSYGLIAHAVLQLPTREAHAKAFGTCSSHICVILAFYIPGLFSYLTHRFGHHTVPKPVHILLSNIYLLLPPALNPLIYGARTKQIRDRLLETFTFRKSPL

SEQ ID NO: 59974 - protein, 298 aa, Homo sapiens
  Payload ID: 11928
  Gene Symbol: OR52Z1
  Gene Name: olfactory receptor, family 52, subfamily Z, member 1 (gene/pseudogene)
  ENSP ID: ENSP00000484570
MGIPGLEGLHTWISIPFSFMYIVAVAGNIFLIFLIMTERSLHEPMYLFLSMLASADFLLATAAAPKVLAILWFHSMDISFGSCVSQMFFIHFIFVAESAILLAMAFDRYVAICYPLRYTILTSSAVRKIGIAAVVRSFFICCPFIFLVYRLTYCGRNIIPHSYCEHIARLACGNINVNIIYGLTVALLSTGLDIVLIIISYTMILHSVFQISSWAARFKALSTCGSHICVIFMFYTPAFFSFLAHRFGGKTIPHHIHILVGSLYVLVPPMLNPIIYGVKTKQIKDRVILLFSPISVCC

SEQ ID NO: 59975 - protein, 318 aa, Homo sapiens
  Payload ID: 11929
  Gene Symbol: OR56A1
  Gene Name: olfactory receptor, family 56, subfamily A, member 1
  Uniprot ID: Q8NGH5
  ENSP ID: ENSP00000321246
MIQPMASPSNSSTVPVSEFLLICFPNFQSWQHWLSLPLSLLFLLAMGANTTLLITIQLEASLHQPLYYLLSLLSLLDIVLCLTVIPKVLAIFWYDLRSISFPACFLQMFIMNSFLPMESCTFMVMAYDRYVAICHPLRYPSIITNQFVAKASVFIVVRNALLTAPIPILTSLLHYCGENVIENCICANLSVSRLSCDNFTLNRIYQFVAGWTLLGSDLFLIFLSYTFILRAVLRFKAEGAAVKALSTCGSHFILILFFSTILLVVVLTNVARKKVPMDILILLNVLHHLIPPALNPIVYGVRTKEIKQGIQKLLQRGR

SEQ ID NO: 59976 - protein, 315 aa, Homo sapiens
  Payload ID: 11930
  Gene Symbol: OR56A3
  Gene Name: olfactory receptor, family 56, subfamily A, member 3
  Uniprot ID: Q8NH54
  ENSP ID: ENSP00000331572
MTTHRNDTLSTEASDFLLNCFVRSPSWQHWLSLPLSLLFLLAVGANTTLLMTIWLEASLHQPLYYLLSLLSLLDIVLCLTVIPKVLTIFWFDLRPISFPACFLQMYIMNCFLAMESCTFMVMAYDRYVAICHPLRYPSIITDHFVVKAAMFILTRNVLMTLPIPILSAQLRYCGRNVIENCICANMSVSRLSCDDVTINHLYQFAGGWTLLGSDLILIFLSYTFILRAVLRLKAEGAVAKALSTCGSHFMLILFFSTILLVFVLTHVAKKKVSPDVPVLLNVLHHVIPAALNPIIYGVRTQEIKQGMQRLLKKGC

SEQ ID NO: 59977 - protein, 365 aa, Homo sapiens
  Payload ID: 11931
  Gene Symbol: OR56A4
  Gene Name: olfactory receptor, family 56, subfamily A, member 4
  Uniprot ID: Q8NGH8
  ENSP ID: ENSP00000328215
MMTVILKTLLGQIQGLSGNPHSTTSRMYFLCFCTSLLRFKVHWVSRLIRKLYMASPSNDSTAPVSEFLLICFPNFQSWQHWLSLPLSLLFLLAMGANTTLLITIQLEASLHQPLYYLLSLLSLLDIVLCLTVIPKVLAIFWFDLRSISFPACFLQMFIMNSFLTMESCTFMVMAYDRYVAICHPLRYPSIITDQFVARAVVFVIARNAFVSLPVPMLSARLRYCAGNIIKNCICSNLSVSKLSCDDITFNQLYQFVAGWTLLGSDLILIVISYSFILKVVLRIKAEGAVAKALSTCGSHFILILFFSTVLLVLVITNLARKRIPPDVPILLNILHHLIPPALNPIVYGVRTKEIKQGIQNLLKRL

SEQ ID NO: 59978 - protein, 246 aa, Homo sapiens
  Payload ID: 11932
  Gene Symbol: OR56A5
  Gene Name: olfactory receptor, family 56, subfamily A, member 5
  ENSP ID: ENSP00000478523
LSLLDIVLCLTVIPKVLAIFWFDLRSISFPACFLQVFIMNSFLTMESCTFMIMAYDRYVAICKPLQYSSIITDQFVARAAIFVVARNGLLTMPIPILSSRLRYCAGHIIKNCICTNVSVSKLSCDDITLNQSYQFVIGWTLLGSDLILIVLSYFFILKTVLRIKGEGDMAKALGTCGSHFILILFFTTVLLVLVITNLARKRIPPDVPILLNILHHLIPPALNPIVYGVRTKEIKQGIQNLLRRLC

SEQ ID NO: 59979 - protein, 313 aa, Homo sapiens
  Payload ID: 11932
  Gene Symbol: OR56A5
  Gene Name: olfactory receptor, family 56, subfamily A, member 5
  Uniprot ID: P0C7T3
  ENSP ID: ENSP00000481594
MTLPSNNSTSPVFEFFLICFPSFQSWQHWLSLPLSLLFLLAMGANATLLITIYLEASLHQPLYYLLSLLSLLDIVLCLTVIPKVLAIFWFDLRSISFPACFLQVFIMNSFLTMESCTFMIMAYDRYVAICKPLQYSSIITDQFVARAAIFVVARNGLLTMPIPILSSRLRYCAGHIIKNCICTNVSVSKLSCDDITLNQSYQFVIGWTLLGSDLILIVLSYFFILKTVLRIKGEGDMAKALGTCGSHFILILFFTTVLLVLVITNLARKRIPPDVPILLNILHHLIPPALNPIVYGVRTKEIKQGIQNLLRRL

SEQ ID NO: 59980 - protein, 324 aa, Homo sapiens
  Payload ID: 11933
  Gene Symbol: OR56B1
  Gene Name: olfactory receptor, family 56, subfamily B, member 1
  Uniprot ID: Q8NGI3
  ENSP ID: ENSP00000322939
MNHMSASLKISNSSKFQVSEFILLGFPGIHSWQHWLSLPLALLYLSALAANTLILIIIWQNPSLQQPMYIFLGILCMVDMGLATTIIPKILAIFWFDAKVISLPECFAQIYAIHFFVGMESGILLCMAFDRYVAICHPLRYPSIVTSSLILKATLFMVLRNGLFVTPVPVLAAQRDYCSKNEIEHCLCSNLGVTSLACDDRRPNSICQLVLAWLGMGSDLSLIILSYILILYSVLRLNSAEAAAKALSTCSSHLTLILFFYTIVVVISVTHLTEMKATLIPVLLNVLHNIIPPSLNPTVYALQTKELRAAFQKVLFALTKEIRS

SEQ ID NO: 59981 - protein, 319 aa, Homo sapiens
  Payload ID: 11934
  Gene Symbol: OR56B4
  Gene Name: olfactory receptor, family 56, subfamily B, member 4
  Uniprot ID: Q8NH76
  ENSP ID: ENSP00000321196
MDTSTSVTYDSSLQISQFILMGLPGIHEWQHWLSLPLTLLYLLALGANLLIIITIQHETVLHEPMYHLLGILAVVDIGLATTIMPKILAIFWFDAKAISLPMCFAQIYAIHCFFCIESGIFLCMAVDRYIAICRPLQYPSIVTKAFVFKATGFIMLRNGLLTIPVPILAAQRHYCSRNEIEHCLCSNLGVISLACDDITVNKFYQLMLAWVLVGSDMALVFSSYAVILHSVLRLNSAEAMSKALSTCSSHLILILFHTGIIVLSVTHLAEKKIPLIPVFLNVLHNVIPPALNPLACALRMHKLRLGFQRLLGLGQDVSK

SEQ ID NO: 59982 - protein, 327 aa, Homo sapiens
  Payload ID: 11935
  Gene Symbol: OR6A2
  Gene Name: olfactory receptor, family 6, subfamily A, member 2
  Uniprot ID: O95222
  ENSP ID: ENSP00000330384
MEWRNHSGRVSEFVLLGFPAPAPLQVLLFALLLLAYVLVLTENTLIIMAIRNHSTLHKPMYFFLANMSFLEIWYVTVTIPKMLAGFVGSKQDHGQLISFEGCMTQLYFFLGLGCTECVLLAVMAYDRYMAICYPLHYPVIVSGRLCVQMAAGSWAGGFGISMVKVFLISGLSYCGPNIINHFFCDVSPLLNLSCTDMSTAELTDFILAIFILLGPLSVTGASYVAITGAVMHIPSAAGRYKAFSTCASHLTVVIIFYAASIFIYARPKALSAFDTNKLVSVLYAVIVPLLNPIIYCLRNQEVKRALCCTLHLYQHQDPDPKKASRNV

SEQ ID NO: 59983 - protein, 311 aa, Homo sapiens
  Payload ID: 11936
  Gene Symbol: OR6B1
  Gene Name: olfactory receptor, family 6, subfamily B, member 1
  Uniprot ID: O95007
  ENSP ID: ENSP00000386151
MELENQTRVTKFILVGFPGSLSMRAAMFLIFLVAYILTVAENVIIILLVLQNRPLHKPMYFFLANLSFLETWYISVTVPKLLFSFWSVNNSISFTLCMIQLYFFIALMCTECVLLAAMAYDRYVAICRPLHYPTIMSHGLCFRLALGSWAIGFGISLAKIYFISCLSFCGPNVINHFFCDISPVLNLSCTDMSITELVDFILALVIFLFPLFITVLSYGCILATILCMPTGKQKAFSTCASHLVVVTIFYSAIIFMYARPRVIHAFNMNKIISIFYAIVTPSLNPFIYCLRNREVKEALKKLAYCQASRSD

SEQ ID NO: 59984 - protein, 312 aa, Homo sapiens
  Payload ID: 11937
  Gene Symbol: OR6B2
  Gene Name: olfactory receptor, family 6, subfamily B, member 2
  Uniprot ID: Q6IFH4
  ENSP ID: ENSP00000384563
MSGENVTKVSTFILVGLPTAPGLQYLLFLLFLLTYLFVLVENLAIILIVWSSTSLHRPMYYFLSSMSFLEIWYVSDITPKMLEGFLLQQKRISFVGCMTQLYFFSSLVCTECVLLASMAYDRYVAICHPLRYHVLVTPGLCLQLVGFSFVSGFTISMIKVCFISSVTFCGSNVLNHFFCDISPILKLACTDFSTAELVDFILAFIILVFPLLATILSYWHITLAVLRIPSATGCWRAFSTCASHLTVVTVFYTALLFMYVRPQAIDSQSSNKLISAVYTVVTPIINPLIYCLRNKEFKDALKKALGLGQTSH

SEQ ID NO: 59985 - protein, 331 aa, Homo sapiens
  Payload ID: 11938
  Gene Symbol: OR6B3
  Gene Name: olfactory receptor, family 6, subfamily B, member 3
  Uniprot ID: Q8NGW1
  ENSP ID: ENSP00000322435
MSGENVTRVGTFILVGFPTAPGLQYLLFLLFLLTYLFVLVENLAIILTVWSSTSLHRPMYYFLSSMSFLEIWYVSDITPKMLEGFLLQQKRISFVGCMTQLYFFSSLVCTECVLLASMAYDRYVAICHPLRYHVLVTPGLCLQLVGFSFVSGFTISMIKVCFISSVTFCGSNVLNHFFCDISPILKLACTDFSTAELVDFILAFIILVFPLLATMLSYAHITLAVLRIPSATGCWRAFFTCASHLTVVTVFYTALLFMYVRPQAIDSRSSNKLISVLYTVITPILNPLIYCLRNKEFKNALKKAFGLTSCAVEGRLSSLLELHLQIHSQPL

SEQ ID NO: 59986 - protein, 312 aa, Homo sapiens
  Payload ID: 11939
  Gene Symbol: OR6C1
  Gene Name: olfactory receptor, family 6, subfamily C, member 1
  Uniprot ID: Q96RD1
  ENSP ID: ENSP00000368990
MRNHTEITEFILLGLTDDPNFQVVIFVFLLITYMLSITGNLTLITITLLDSHLQTPMYFFLRNFSILEISFTTVSIPKFLGNIISGDKTISFNNCIVQLFFFILLGVTEFYLLAAMSYDRYVAICKPLHCLSIMNRRVCTLLVFTSWLVSFLIIFPALMLLLKLHYCRSNIIDHFTCDYFPLLQLACSDTKFLEVMGFSCAAFTLMFTLALIFLSYIYIIRTILRIPSTSQRTKAFSTCSSHMVVVSISYGSCIFMYIKPSAKDRVSLSKGVAILNTSVAPMMNPFIYSLRNQQVKQAFINMARKTVFFTST

SEQ ID NO: 59987 - protein, 312 aa, Homo sapiens
  Payload ID: 11940
  Gene Symbol: OR6C2
  Gene Name: olfactory receptor, family 6, subfamily C, member 2
  Uniprot ID: Q9NZP2
  ENSP ID: ENSP00000323606
MKNHTVIRTFILLGLTGDPHLQVLLFIFLFLTYMLSVTGNLTIITLTLVDHHLKTPMYFFLRNFSFLEVSFTTVCIPRFLYNISMGDNTITYNACASQIFFVILFGATEFFLLAAMSYDRYVAICKPLHYVVIMNNRVCTLLVLCCWVAGLMIIVPPLSLGLQLEFCDSNAIDHFSCDAGPLLKISCSDTWVIEQMVILMAVFALIITLVCVILSYLYIVRTILKFPSVQQRKKAFSTCSSHMIVVSIAYGSCIFIYIKPSAKDEVAINKGVSVLTTSVAPLLNPFIYTLRNKQVKQAFSDSIKRIAFLSKK

SEQ ID NO: 59988 - protein, 311 aa, Homo sapiens
  Payload ID: 11941
  Gene Symbol: OR6C3
  Gene Name: olfactory receptor, family 6, subfamily C, member 3
  Uniprot ID: Q9NZP0
  ENSP ID: ENSP00000368989
MNHTMVTEFVLLGLSDDPDLQIVIFLFLFITYILSVTGNLTIITLTFVDSHLQTPMYFFLRNFSFLEISFTTVCIPRFLGAIITRNKTISYNNCAAQLFFFIFMGVTEFYILTAMSYDRYVAICKPLHYTSIMNRKLCTLLVLCAWLSGFLTIFPPLMLLLQLDYCASNVIDHFACDYFPLLQLSCSDTWLLEVIGFYFALVTLLFTLALVILSYMYIIRTILRIPSASQRKKAFSTCSSHMIVISISYGSCIFMYANPSAKEKASLTKGIAILNTSVAPMLNPFIYTLRNQQVKQAFKNVVHKVVFYANQ

SEQ ID NO: 59989 - protein, 309 aa, Homo sapiens
  Payload ID: 11942
  Gene Symbol: OR6C4
  Gene Name: olfactory receptor, family 6, subfamily C, member 4
  Uniprot ID: Q8NGE1
  ENSP ID: ENSP00000377799
MKNRTMFGEFILLGLTNQPELQVMIFIFLFLTYMLSILGNLTIITLTLLDPHLQTPMYFFLRNFSFLEISFTSIFIPRFLTSMTTGNKVISFAGCLTQYFFAIFLGATEFYLLASMSYDRYVAICKPLHYLTIMSSRVCIQLVFCSWLGGFLAILPPIILMTQVDFCVSNILNHYYCDYGPLVELACSDTSLLELMVILLAVVTLMVTLVLVTLSYTYIIRTILRIPSAQQRTKAFSTCSSHMIVISLSYGSCMFMYINPSAKEGGAFNKGIAVLITSVTPLLNPFIYTLRNQQVKQAFKDSVKKIVKL

SEQ ID NO: 59990 - protein, 314 aa, Homo sapiens
  Payload ID: 11943
  Gene Symbol: OR6C6
  Gene Name: olfactory receptor, family 6, subfamily C, member 6
  Uniprot ID: A6NF89
  ENSP ID: ENSP00000351211
MKNKSMEIEFILLGLTDDPQLQIVIFLFLFLNYTLSLMGNLIIIILTLLDPRLKTPMYFFLRNFSFLEVIFTTVCIPRFLITIVTRDKTISYNNCATQLFFILLPGVTEFYLLAAMSYDRYVAICKPLHYPIIMSSKVCYQLVLSSWVTGFLIIFPPLVMGLKLDFCASKTIDHFMCETSPILQISCTDTHVLELMSFTLAVVTLVVTLVLVILSYTCIIKTILKFSSAQQRNKAFSTCTSHMIVVSMTYGSCIFMYIKPSAKERVTVSKGVALLYTSIAPLLNPFIYTLRNQQVKEVFWDVLQKNLCFSKRPF

SEQ ID NO: 59991 - protein, 312 aa, Homo sapiens
  Payload ID: 11944
  Gene Symbol: OR6C65
  Gene Name: olfactory receptor, family 6, subfamily C, member 65
  Uniprot ID: A6NJZ3
  ENSP ID: ENSP00000368986
MPNMTSIREFILLGFTDNPELQVVIFFFMLITYLLSVSGNMIIIMLTLSNIHLKTPMYFFLRNFSFLEISFTTVFIPRFLINIATGDTTISYNASMAQVFFLILLGSTEFFLLAVMSYDRYVAICKPLHYTTIMSNKVCNWLVISSWLAGFLIIFPPVIMGLQLDFCDSSTIDHFICDSSPMLLIACTDTQFLELMAFLLAVFTLMVTLALVVLSYTLILKTILKIPSAQQRKKAFSTCSSHMIVVSVSYGSCIFMCVKTSAKEGMALSKGVAVLNTSVAPMLNPFIYTLRNQQVKQALREFTKKILSLNKQ

SEQ ID NO: 59992 - protein, 312 aa, Homo sapiens
  Payload ID: 11945
  Gene Symbol: OR6C68
  Gene Name: olfactory receptor, family 6, subfamily C, member 68
  Uniprot ID: A6NDL8
  ENSP ID: ENSP00000448811
MRKHTAITTFILLGLTEDPQLQVLLFMFLFITYMLSVTGKLTIIALTMLDPHLKTPMYFFLQNLSFLEISFTATCVPRFLYSISTGNKIITYNACVIQLFFADLFGVTEFFLLATMSYDRYVAICKPLHYMAIMSNKVCKTMVICCWMAALMIILPPLSLGFHLEFCDSNVINHFGCDALPILKIPCSDTSLIEQMVVASAVLTFIITLVCVVLSYTYIIRTILKFPSVQQKKKAFSTCSSHITVVSITYGSCIFIYIKPSAKEEVNINKGVSVLISSISPMLNSFIYTLRNEQVKQAFHDSLKKIAFRLKK

SEQ ID NO: 59993 - protein, 312 aa, Homo sapiens
  Payload ID: 11946
  Gene Symbol: OR6C70
  Gene Name: olfactory receptor, family 6, subfamily C, member 70
  Uniprot ID: A6NIJ9
  ENSP ID: ENSP00000329153
MKNHTRQIEFILLGLTDNSQLQIVIFLFLLLNCVLSMIGNFTIIALILLDSQLKTPMYFFLRNFSFLEISFTTACIPRFLITIVTREKTISCNGCISQLFFYIFLGVTEFFLLAALSYDRYVAICKPLRYMSIMSNKVCYQLVFSSWVTGFLIIFTPLILGLNLDFCASNIIDHFICDISLILQLSCSDTHLLELIAFLLAVMTLIVTLFLVILSYSYIIKTILKFPSAQQKKKAFSTCSSHMIVVSITYGSCMFIYIKPSANERVALSKGVTVLNTSVAPLLNPFIYTLRNQQVKQAFKAVFRKIFSASDK

SEQ ID NO: 59994 - protein, 312 aa, Homo sapiens
  Payload ID: 11947
  Gene Symbol: OR6C74
  Gene Name: olfactory receptor, family 6, subfamily C, member 74
  Uniprot ID: A6NCV1
  ENSP ID: ENSP00000342836
MRNHTTVANFILLGLTDDPQLQVIIFLLLFFTYMLSITGNLTIITLTLLDLHLKTPMYFFLRNFSFLEVSFTTVYIPKFLVSMATGDKTISYNDCAAQLFFTILLGATEFFLLAAMSYERYVAICKPLHYTTIMSSRVCSLLVFASWMAGFLIIFPPLLMGLQLDFCAANTVDHFFCDVSPILQLSCTDTDIIELMMLLSAILTLLVTLVLVILSYTNIIRTILKIPSSQQRKKAFSTCSSHMVVVSISYGSCIFMYVKPSAKERVSLNKGIALLSTSVAPMLNPFIYTLRNKQVKDVFKHTVKKIELFSMK

SEQ ID NO: 59995 - protein, 312 aa, Homo sapiens
  Payload ID: 11948
  Gene Symbol: OR6C75
  Gene Name: olfactory receptor, family 6, subfamily C, member 75
  Uniprot ID: A6NL08
  ENSP ID: ENSP00000368987
MRNSTAVTDFILLGLTSDPQWQVVLFIFLLVTYMLSVTGNLIIITLTLSDPHLQTPMYFFLRNFSFLEISFTSVCIPRFLVTVVTGNRTISYNGCVAQLFFFIFLGVTEFYLLAAMSYDRCMAICKPLHYTIIMSTRVCTLLVFSSWLAGFLIIFPPVMLLLQLDFCASNVIDHFICDSSPMLQLSCTNTHFLELMAFFLAVVTLMVTLTLVILSYTNIIRTILKIPSMSQRKKAFSTCSSHMIVVSISYSSCIFMYIKTSARERVTLSKGVAVLNTSVAPLLNPFIYTLRNKQVKQAFKSMVQKMIFSLNK

SEQ ID NO: 59996 - protein, 312 aa, Homo sapiens
  Payload ID: 11949
  Gene Symbol: OR6C76
  Gene Name: olfactory receptor, family 6, subfamily C, member 76
  Uniprot ID: A6NM76
  ENSP ID: ENSP00000328402
MKNRTSVTDFILLGLTDNPQLQVVIFSFLFLTYVLSVTGNLTIISLTLLDSHLKTPMYFFLRNFSLEISFTSVCNPRFLISILTGDKSISYNACAAQLFFFIFLGSTEFFLLASMSYDCYVAICKPLHYTTIMSDRICYQLIISSWLAGFLVIFPPLAMGLQLDFCDSNVIDHFTCDSAPLLQISCTDTSTLELMSFILALFTLISTLILVILSYTYIIRTILRIPSAQQRKKAFSTCSSHVIVVSISYGSCIFMYVKTSAKEGVALTKGVAILNTSVAPMLNPFIYTLRNQQVKQAFKDVLRKISHKKKKH

SEQ ID NO: 59997 - protein, 308 aa, Homo sapiens
  Payload ID: 11950
  Gene Symbol: OR6F1
  Gene Name: olfactory receptor, family 6, subfamily F, member 1
  Uniprot ID: Q8NGZ6
  ENSP ID: ENSP00000305640
MDTGNKTLPQDFLLLGFPGSQTLQLSLFMLFLVMYILTVSGNVAILMLVSTSHQLHTPMYFFLSNLSFLEIWYTTAAVPKALAILLGRSQTISFTSCLLQMYFVFSLGCTEYFLLAAMAYDRCLAICYPLHYGAIMSSLLSAQLALGSWVCGFVAIAVPTALISGLSFCGPRAINHFFCDIAPWIALACTNTQAVELVAFVIAVVVILSSCLITFVSYVYIISTILRIPSASGRSKAFSTCSSHLTVVLIWYGSTVFLHVRTSIKDALDLIKAVHVLNTVVTPVLNPFIYTLRNKEVRETLLKKWKGK

SEQ ID NO: 59998 - protein, 347 aa, Homo sapiens
  Payload ID: 11951
  Gene Symbol: OR6J1
  Gene Name: olfactory receptor, family 6, subfamily J, member 1 (gene/pseudogene)
  Uniprot ID: Q8NGC5
  ENSP ID: ENSP00000437629
MGNWTAAVTEFVLLGFSLSREVELLLLVLLLPTFLLTLLGNLLIISTVLSCSRLHTPMYFFLCNLSILDILFTSVISPKVLANLGSRDKTISFAGCITQCYFYFFLGTVEFLLLTVMSYDRYATICCPLRYTTIMRPSVCIGTVVFSWVGGFLSVLFPTILISQLPFCGSNIINHFFCDSGPLLALACADTTAIELMDFMLSSMVILCCIVLVAYSYTYIILTIVRIPSASGRKKAFNTCASHLTIVIISSGITVFIYVTPSQKEYLEINKIPLVLSSVVTPFLNPFIYTLRNDTVQGVLRDVWVRVRGVFEKRMRAVLRSRLSSNKDHQGRACSSPPCVYSVKLQC

SEQ ID NO: 59999 - protein, 324 aa, Homo sapiens
  Payload ID: 11952
  Gene Symbol: OR6K2
  Gene Name: olfactory receptor, family 6, subfamily K, member 2
  Uniprot ID: Q8NGY2
  ENSP ID: ENSP00000352626
MESPNRTTIQEFIFSAFPYSWVKSVVCFVPLLFIYAFIVVGNLVIITVVQLNTHLHTPMYTFISALSFLEIWYTTATIPKMLSSLLSERSISFNGCLLQMYFFHSTGICEVCLLTVMAFDHYLAICSPLHYPSIMTPKLCTQLTLSCCVCGFITPLPEIAWISTLPFCGSNHLEHIFCDFLPVLRLACTDTRAIVMIQVVDVIHAVEIITAVMLIFMSYDGIVAVILRIHSAGGRRTAFSTCVSHFIVFSLFFGSVTLMYLRFSATYSLFWDIAIALAFAVLSPFFNPIIYSLRNKEIKEAIKKHIGQAKIFFSVRPGTSSKIF

SEQ ID NO: 60000 - protein, 315 aa, Homo sapiens
  Payload ID: 11953
  Gene Symbol: OR6K3
  Gene Name: olfactory receptor, family 6, subfamily K, member 3
  ENSP ID: ENSP00000357127
MESGNQSTVTEFIFTGFPQLQDGSLLYFFPLLFIYTFIIIDNLLIFSAVRLDTHLHNPMYNFISIFSFLEIWYTTATIPKMLSNLISEKKAISMTGCILQMYFFHSLENSEGILLTTMAIDRYVAICNPLRYQMIMTPRLCAQLSAGSCLFGFLILLPEIVMISTLPFCGPNQIHQIFCDLVPVLSLACTDTSMILIEDVIHAVTIIITFLIIALSYVRIVTVILRIPSSEGRQKAFSTCAGHLMVFPIFFGSVSLMYLRFSDTYPPVLDTAIALMFTVLAPFFNPIIYSLRNKDMNNAIKKLFCLQKVLNKPGG

SEQ ID NO: 60001 - protein, 331 aa, Homo sapiens
  Payload ID: 11953
  Gene Symbol: OR6K3
  Gene Name: olfactory receptor, family 6, subfamily K, member 3
  Uniprot ID: Q8NGY3
  ENSP ID: ENSP00000357128
MCWTMPSPFTGSSTRNMESGNQSTVTEFIFTGFPQLQDGSLLYFFPLLFIYTFIIIDNLLIFSAVRLDTHLHNPMYNFISIFSFLEIWYTTATIPKMLSNLISEKKAISMTGCILQMYFFHSLENSEGILLTTMAIDRYVAICNPLRYQMIMTPRLCAQLSAGSCLFGFLILLPEIVMISTLPFCGPNQIHQIFCDLVPVLSLACTDTSMILIEDVIHAVTIIITFLIIALSYVRIVTVILRIPSSEGRQKAFSTCAGHLMVFPIFFGSVSLMYLRFSDTYPPVLDTAIALMFTVLAPFFNPIIYSLRNKDMNNAIKKLFCLQKVLNKPGG

SEQ ID NO: 60002 - protein, 343 aa, Homo sapiens
  Payload ID: 11954
  Gene Symbol: OR6K6
  Gene Name: olfactory receptor, family 6, subfamily K, member 6
  Uniprot ID: Q8NGW6
  ENSP ID: ENSP00000357126
MKQYSVGNQHSNYRSLLFPFLCSQMTQLTASGNQTMVTEFLFSMFPHAHRGGLLFFIPLLLIYGFILTGNLIMFIVIQVGMALHTPLYFFISVLSFLEICYTTTTIPKMLSCLISEQKSISVAGCLLQMYFFHSLGITESCVLTAMAIDRYIAICNPLRYPTIMIPKLCIQLTVGSCFCGFLLVLPEIAWISTLPFCGSNQIHQIFCDFTPVLSLACTDTFLVVIVDAIHAAEIVASFLVIALSYIRIIIVILGMHSAEGHHKAFSTCAAHLAVFLLFFGSVAVMYLRFSATYSVFWDTAIAVTFVILAPFFNPIIYSLKNKDMKEAIGRLFHYQKRAGWAGK

SEQ ID NO: 60003 - protein, 313 aa, Homo sapiens
  Payload ID: 11955
  Gene Symbol: OR6M1
  Gene Name: olfactory receptor, family 6, subfamily M, member 1
  Uniprot ID: Q8NGM8
  ENSP ID: ENSP00000311038
MGNWSTVTEITLIAFPALLEIRISLFVVLVVTYTLTATGNITIISLIWIDHRLQTPMYFFLSNLSFLDILYTTVITPKLLACLLGEEKTISFAGCMIQTYFYFFLGTVEFILLAVMSFDRYMAICDPLHYTVIMNSRACLLLVLGCWVGAFLSVLFPTIVVTRLPYCRKEINHFFCDIAPLLQVACINTHLIEKINFLLSALVILSSLAFTTGSYVYIISTILRIPSTQGRQKAFSTCASHITVVSIAHGSNIFVYVRPNQNSSLDYDKVAAVLITVVTPLLNPFIYSLRNEKVQEVLRETVNRIMTLIQRKT

SEQ ID NO: 60004 - protein, 312 aa, Homo sapiens
  Payload ID: 11956
  Gene Symbol: OR6N1
  Gene Name: olfactory receptor, family 6, subfamily N, member 1
  Uniprot ID: Q8NGY5
  ENSP ID: ENSP00000335535
MDTGNWSQVAEFIILGFPHLQGVQIYLFLLLLLIYLMTVLGNLLIFLVVCLDSRLHTPMYHFVSILSFSELGYTAATIPKMLANLLSEKKTISFSGCLLQIYFFHSLGATECYLLTAMAYDRYLAICRPLHYPTLMTPTLCAEIAIGCWLGGLAGPVVEISLISRLPFCGPNRIQHVFCDFPPVLSLACTDTSINVLVDFVINSCKILATFLLILCSYVQIICTVLRIPSAAGKRKAISTCASHFTVVLIFYGSILSMYVQLKKSYSLDYDQALAVVYSVLTPFLNPFIYSLRNKEIKEAVRRQLKRIGILA

SEQ ID NO: 60005 - protein, 317 aa, Homo sapiens
  Payload ID: 11957
  Gene Symbol: OR6N2
  Gene Name: olfactory receptor, family 6, subfamily N, member 2
  Uniprot ID: Q8NGY6
  ENSP ID: ENSP00000344101
MDQYNHSSLAEFVFLGFASVGYVRGWLFVLLLLAYLFTICGNMLIFSVIRLDAALHTPMYHFVSVLSFLELWYTATTIPKMLSNILSEKKTISFAGCLLQTYFFHSLGASECYLLTAMAYDRYLAICRPLHYPIIMTTTLCAKMAAACWTCGFLCPISEVILASQLPFCAYNEIQHIFCDFPPLLSLACKDTSANILVDFAINAFIILITFFFIMISYARIIGAVLKIKTASGRKKAFSTCASHLAVVLIFFGSIIFMYVRLKKSYSLTLDRTLAIVYSVLTPMVNPIIYSLRNKEIIKAIKRTIFQKGDKASLAHL

SEQ ID NO: 60006 - protein, 317 aa, Homo sapiens
  Payload ID: 11958
  Gene Symbol: OR6P1
  Gene Name: olfactory receptor, family 6, subfamily P, member 1
  Uniprot ID: Q8NGX9
  ENSP ID: ENSP00000334721
MRNLSGGHVEEFVLVGFPTTPPLQLLLFVLFFAIYLLTLLENALIVFTIWLAPSLHRPMYFFLGHLSFLELWYINVTIPRLLAAFLTQDGRVSYVGCMTQLYFFIALACTECVLLAVMAYDRYLAICGPLLYPSLMPSSLATRLAAASWGSGFFSSMMKLLFISQLSYCGPNIINHFFCDISPLLNLTCSDKEQAELVDFLLALVMILLPLLAVVSSYTAIIAAILRIPTSRGRHKAFSTCAAHLAVVVIYYSSTLFTYARPRAMYTFNHNKIISVLYTIIVPFFNPAIYCLRNKEVKEAFRKTVMGRCHYPRDVQD

SEQ ID NO: 60007 - protein, 317 aa, Homo sapiens; identical to SEQ ID NO: 59447
  Payload ID: 11959
  Gene Symbol: OR6Q1
  Gene Name: olfactory receptor, family 6, subfamily Q, member 1 (gene/pseudogene)
  Uniprot ID: Q8NGQ2
  ENSP ID: ENSP00000485678

SEQ ID NO: 60008 - protein, 331 aa, Homo sapiens
  Payload ID: 11960
  Gene Symbol: OR6S1
  Gene Name: olfactory receptor, family 6, subfamily S, member 1
  Uniprot ID: Q8NH40
  ENSP ID: ENSP00000313110
MSPDGNHSSDPTEFVLAGLPNLNSARVELFSVFLLVYLLNLTGNVLIVGVVRADTRLQTPMYFFLGNLSCLEILLTSVIIPKMLSNFLSRQHTISFAACITQFYFYFFLGASEFLLLAVMSADRYLAICHPLRYPLLMSGAVCFRVALACWVGGLVPVLGPTVAVALLPFCKQGAVVQHFFCDSGPLLRLACTNTKKLEETDFVLASLVIVSSLLITAVSYGLIVLAVLSIPSASGRQKAFSTCTSHLIVVTLFYGSAIFLYVRPSQSGSVDTNWAVTVITTFVTPLLNPFIYALRNEQVKEALKDMFRKVVAGVLGNLLLDKCLSEKAVK

SEQ ID NO: 60009 - protein, 323 aa, Homo sapiens
  Payload ID: 11961
  Gene Symbol: OR6T1
  Gene Name: olfactory receptor, family 6, subfamily T, member 1
  Uniprot ID: Q8NGN1
  ENSP ID: ENSP00000325203
MNPENWTQVTSFVLLGFPSSHLIQFLVFLGLMVTYIVTATGKLLIIVLSWIDQRLHIQMYFFLRNFSFLELLLVTVVVPKMLVVILTGDHTISFVSCIIQSYLYFFLGTTDFFLLAVMSLDRYLAICRPLRYETLMNGHVCSQLVLASWLAGFLWVLCPTVLMASLPFCGPNGIDHFFRDSWPLLRLSCGDTHLLKLVAFMLSTLVLLGSLALTSVSYACILATVLRAPTAAERRKAFSTCASHLTVVVIIYGSSIFLYIRMSEAQSKLLNKGASVLSCIITPLLNPFIFTLRNDKVQQALREALGWPRLTAVMKLRVTSQRK

SEQ ID NO: 60010 - protein, 313 aa, Homo sapiens
  Payload ID: 11962
  Gene Symbol: OR6V1
  Gene Name: olfactory receptor, family 6, subfamily V, member 1
  Uniprot ID: Q8N148
  ENSP ID: ENSP00000396085
MANLSQPSEFVLLGFSSFGELQALLYGPFLMLYLLAFMGNTIIIVMVIADTHLHTPMYFFLGNFSLLEILVTMTAVPRMLSDLLVPHKVITFTGCMVQFYFHFSLGSTSFLILTDMALDRFVAICHPLRYGTLMSRAMCVQLAGAAWAAPFLAMVPTVLSRAHLDYCHGDVINHFFCDNEPLLQLSCSDTRLLEFWDFLMALTFVLSSFLVTLISYGYIVTTVLRIPSASSCQKAFSTCGSHLTLVFIGYSSTIFLYVRPGKAHSVQVRKVVALVTSVLTPFLNPFILTFCNQTVKTVLQGQMQRLKGLCKAQ

SEQ ID NO: 60011 - protein, 313 aa, Homo sapiens; identical to SEQ ID NO: 60010
  Payload ID: 11962
  Gene Symbol: OR6V1
  Gene Name: olfactory receptor, family 6, subfamily V, member 1
  Uniprot ID: Q8N148
  ENSP ID: ENSP00000483439

SEQ ID NO: 60012 - protein, 312 aa, Homo sapiens
  Payload ID: 11963
  Gene Symbol: OR6X1
  Gene Name: olfactory receptor, family 6, subfamily X, member 1
  Uniprot ID: Q8NH79
  ENSP ID: ENSP00000333724
MRNGTVITEFILLGFPVIQGLQTPLFIAIFLTYILTLAGNGLIIATVWAEPRLQIPMYFFLCNLSFLEIWYTTTVIPKLLGTFVVARTVICMSCCLLQAFFHFFVGTTEFLILTIMSFDRYLTICNPLHHPTIMTSKLCLQLALSSWVVGFTIVFCQTMLLIQLPFCGNNVISHFYCDVGPSLKAACIDTSILELLGVIATILVIPGSLLFNMISYIYILSAILRIPSATGHQKTFSTCASHLTVVSLLYGAVLFMYLRPTAHSSFKINKVVSVLNTILTPLLNPFIYTIRNKEVKGALRKAMTCPKTGHAK

SEQ ID NO: 60013 - protein, 325 aa, Homo sapiens
  Payload ID: 11964
  Gene Symbol: OR6Y1
  Gene Name: olfactory receptor, family 6, subfamily Y, member 1
  Uniprot ID: Q8NGX8
  ENSP ID: ENSP00000304807
MTTIILEVDNHTVTTRFILLGFPTRPAFQLLFFSIFLATYLLTLLENLLIILAIHSDGQLHKPMYFFLSHLSFLEMWYVTVISPKMLVDFLSHDKSISFNGCMTQLYFFVTFVCTEYILLAIMAFDRYVAICNPLRYPVIMTNQLCGTLAGGCWFCGLMTAMIKMVFIAQLHYCGMPQINHYFCDISPLLNVSCEDASQAEMVDFFLALMVIAIPLCVVVASYAAILATILRIPSAQGRQKAFSTCASHLTVVILFYSMTLFTYARPKLMYAYNSNKVVSVLYTVIVPLLNPIIYCLRNHEVKAALRKTIHCRGSGPQGNGAFSS

SEQ ID NO: 60014 - protein, 309 aa, Homo sapiens
  Payload ID: 11965
  Gene Symbol: OR7A10
  Gene Name: olfactory receptor, family 7, subfamily A, member 10
  Uniprot ID: O76100
  ENSP ID: ENSP00000248058
MKSWNNTIILEFLLLGISEEPELQAFLFGLFLSMYLVTVLGNLLIILATISDSHLHTPMYFFLSNLSFVDICFVSTTVPKMLVNIQTHNKVITYAGCITQMCFFLLFVGLDNFLLTVMAYDRFVAICHPLHYMVIMNPQLCGLLVLASWIMSVLNSMLQSLMVLPLPFCTHMEIPHFFCEINQVVHLACSDTFLNDIVMYFAVALLGGGPLTGILYSYSKIVSSIRAISSAQGKYKAFSTCASHLSVVSLFYGTCLGVYLSSAATHNSHTGAAASVMYTVVTPMLNPFIYSLRNKHIKGAMKTFFRGKQ

SEQ ID NO: 60015 - protein, 309 aa, Homo sapiens
  Payload ID: 11966
  Gene Symbol: OR7A17
  Gene Name: olfactory receptor, family 7, subfamily A, member 17
  Uniprot ID: O14581
  ENSP ID: ENSP00000328144
MEPENDTGISEFVLLGLSEEPELQPFLFGLFLSMYLVTVLGNLLIILATISDSHLHTPMYFFLSNLSFADICFISTTIPKMLINIQTQSRVITYAGCITQMCFFVLFGGLDSLLLAVMAYDRFVAICHPLHYTVIMNPRLCGLLVLASWMIAALNSLSQSLMVLWLSFCTDLEIPHFFCELNQVIHLACSDTFLNDMGMYFAAGLLAGGPLVGILCSYSKIVSSIRAISSAQGKYKAFSTCASHLSVVSLFCCTGLGVYLTSAATHNSHTSATASVMYTVATPMLNPFIYSLRNKDIKRALKMSFRGKQ

SEQ ID NO: 60016 - protein, 319 aa, Homo sapiens
  Payload ID: 11967
  Gene Symbol: OR7A5
  Gene Name: olfactory receptor, family 7, subfamily A, member 5
  Uniprot ID: Q15622
  ENSP ID: ENSP00000316955
MEPGNDTQISEFLLLGFSQEPGLQPFLFGLFLSMYLVTVLGNLLIILATISDSHLHTPMYFFLSNLSFADICVTSTTIPKMLMNIQTQNKVITYIACLMQMYFFILFAGFENFLLSVMAYDRFVAICHPLHYMVIMNPHLCGLLVLASWTMSALYSLLQILMVVRLSFCTALEIPHFFCELNQVIQLACSDSFLNHMVIYFTVALLGGGPLTGILYSYSKIISSIHAISSAQGKYKAFSTCASHLSVVSLFYGAILGVYLSSAATRNSHSSATASVMYTVVTPMLNPFIYSLRNKDIKRALGIHLLWGTMKGQFFKKCP

SEQ ID NO: 60017 - protein, 319 aa, Homo sapiens; identical to SEQ ID NO: 60016
  Payload ID: 11967
  Gene Symbol: OR7A5
  Gene Name: olfactory receptor, family 7, subfamily A, member 5
  Uniprot ID: Q15622
  ENSP ID: ENSP00000471977

SEQ ID NO: 60018 - protein, 320 aa, Homo sapiens
  Payload ID: 11968
  Gene Symbol: OR7C1
  Gene Name: olfactory receptor, family 7, subfamily C, member 1
  Uniprot ID: O76099
  ENSP ID: ENSP00000248073
METGNQTHAQEFLLLGFSATSEIQFILFGLFLSMYLVTFTGNLLIILAICSDSHLHTPMYFFLSNLSFADLCFTSTTVPKMLLNILTQNKFITYAGCLSQIFFFTSFGCLDNLLLTVMAYDRFVAVCHPLHYTVIMNPQLCGLLVLGSWCISVMGSLLETLTVLRLSFCTEMEIPHFFCDLLEVLKLACSDTFINNVVIYFATGVLGVISFTGIFFSYYKIVFSILRISSAGRKHKAFSTCGSHLSVVTLFYGTGFGVYLSSAATPSSRTSLVASVMYTMVTPMLNPFIYSLRNTDMKRALGRLLSRATFFNGDITAGLS

SEQ ID NO: 60019 - protein, 319 aa, Homo sapiens
  Payload ID: 11969
  Gene Symbol: OR7C2
  Gene Name: olfactory receptor, family 7, subfamily C, member 2
  Uniprot ID: O60412
  ENSP ID: ENSP00000248072
MERGNQTEVGNFLLLGFAEDSDMQLLLHGLFLSMYLVTIIGNLLIILTISSDSHLHTPMYFFLSNLSFADICFTSTTVPKMLVNIQTQSKMITFAGCLTQIFFFIAFGCLDNLLLTMTAYDRFVAICYPLHYTVIMNPRLCGLLVLGSWCISVMGSLLETLTILRLSFCTNMEIPHFFCDPSEVLKLACSDTFINNIVMYFVTIVLGVFPLCGILFSYSQIFSSVLRVSARGQHKAFSTCGSHLSVVSLFYGTGLGVYLSSAVTPPSRTSLAASVMYTMVTPMLNPFIYSLRNKDMKGSLGRLLLRATSLKEGTIAKLS

SEQ ID NO: 60020 - protein, 312 aa, Homo sapiens
  Payload ID: 11970
  Gene Symbol: OR7D2
  Gene Name: olfactory receptor, family 7, subfamily D, member 2
  Uniprot ID: Q96RA2
  ENSP ID: ENSP00000345563
MEAGNQTGFLEFILLGLSEDPELQPFIFGLFLSMYLVTVLGNLLIILAISSDSHLHTPMYFFLSNLSWVDICFSTCIVPKMLVNIQTENKAISYMDCLTQVYFSMFFPILDTLLLTVMAYDRFVAVCHPLHYMIIMNPHLCGLLVFVTWLIGVMTSLLHISLMMHLIFCKDFEIPHFFCELTYILQLACSDTFLNSTLIYFMTGVLGVFPLLGIIFSYSRIASSIRKMSSSGGKQKALSTCGSHLSVVSLFYGTGIGVHFTSAVTHSSQKISVASVMYTVVTPMLNPFIYSLRNKDVKGALGSLLSRAASCL

SEQ ID NO: 60021 - protein, 312 aa, Homo sapiens
  Payload ID: 11971
  Gene Symbol: OR7D4
  Gene Name: olfactory receptor, family 7, subfamily D, member 4
  Uniprot ID: Q8NG98
  ENSP ID: ENSP00000310488
MEAENLTELSKFLLLGLSDDPELQPVLFGLFLSMYLVTVLGNLLIILAVSSDSHLHTPMYFFLSNLSFVDICFISTTVPKMLVSIQARSKDISYMGCLTQVYFLMMFAGMDTFLLAVMAYDRFVAICHPLHYTVIMNPCLCGLLVLASWFIIFWFSLVHILLMKRLTFSTGTEIPHFFCEPAQVLKVACSNTLLNNIVLYVATALLGVFPVAGILFSYSQIVSSLMGMSSTKGKYKAFSTCGSHLCVVSLFYGTGLGVYLSSAVTHSSQSSSTASVMYAMVTPMLNPFIYSLRNKDVKGALERLLSRADSCP

SEQ ID NO: 60022 - protein, 339 aa, Homo sapiens
  Payload ID: 11972
  Gene Symbol: OR7E24
  Gene Name: olfactory receptor, family 7, subfamily E, member 24
  Uniprot ID: Q6IFN5
  ENSP ID: ENSP00000387523
MSYFPILFFFFLKRCPSYTEPQNLTGVSEFLLLGLSEDPELQPVLAGLFLSMYLVTVLGNLLIILAVSSDSHLHTPMYFFLSNLSLADIGFTSTTVPKMIVDMQTHSRVISYEGCLTQMSFFVLFACMDDMLLSVMAYDRFVAICHPLHYRIIMNPRLCGFLILLSFFISLLDSQLHNLIMLQLTCFKDVDISNFFCDPSQLLHLRCSDTFINEMVIYFMGAIFGCLPISGILFSYYKIVSPILRVPTSDGKYKAFSTCGSHLAVVCLFYGTGLVGYLSSAVLPSPRKSMVASVMYTVVTPMLNPFIYSLRNKDIQSALCRLHGRIIKSHHLHPFCYMG

SEQ ID NO: 60023 - protein, 311 aa, Homo sapiens
  Payload ID: 11973
  Gene Symbol: OR7G1
  Gene Name: olfactory receptor, family 7, subfamily G, member 1
  Uniprot ID: Q8NGA0
  ENSP ID: ENSP00000444134
MGPRNQTAVSEFLLMKVTEDPELKLIPFSLFLSMYLVTILGNLLILLAVISDSHLHTPMYFLLFNLSFTDICLTTTTVPKILVNIQAQNQSITYTGCLTQICLVLVFAGLESCFLAVMAYDRYVAICHPLRYTVLMNVHFWGLLILLSMFMSTMDALVQSLMVLQLSFCKNVEIPLFFCEVVQVIKLACSDTLINNILIYFASSVFGAIPLSGIIFSYSQIVTSVLRMPSARGKYKAFSTCGCHLSVFSLFYGTAFGVYISSAVAESSRITAVASVMYTVVPQMMNPFIYSLRNKEMKKALRKLIGRLFPF

SEQ ID NO: 60024 - protein, 345 aa, Homo sapiens
  Payload ID: 11974
  Gene Symbol: OR7G2
  Gene Name: olfactory receptor, family 7, subfamily G, member 2
  Uniprot ID: Q8NG99
  ENSP ID: ENSP00000303822
MPMQLLLTDFIIFSIRFIINSMEARNQTAISKFLLLGLIEDPELQPVLFSLFLSMYLVTILGNLLILLAVISDSHLHTPMYFFLSNLSFLDICLSTTTIPKMLVNIQAQNRSITYSGCLTQICFVLFFAGLENCLLAAMAYDRYVAICHPLRYTVIMNPRLCGLLILLSLLTSVVNALLLSLMVLRLSFCTDLEIPLFFCELAQVIQLTCSDTLINNILIYFAACIFGGVPLSGIILSYTQITSCVLRMPSASGKHKAVSTCGSHLSIVLLFYGAGLGVYISSVVTDSPRKTAVASVMYSVFPQMVNPFIYSLRNKDMKGTLRKFIGRIPSLLWCAICFGFRFLE

SEQ ID NO: 60025 - protein, 312 aa, Homo sapiens
  Payload ID: 11975
  Gene Symbol: OR7G3
  Gene Name: olfactory receptor, family 7, subfamily G, member 3
  Uniprot ID: Q8NG95
  ENSP ID: ENSP00000302867
MKAGNFSDTPEFFLLGLSGDPELQPILFMLFLSMYLATMLGNLLIILAVNSDSHLHTPMYFLLSILSLVDICFTSTTMPKMLVNIQAQAQSINYTGCLTQICFVLVFVGLENGILVMMAYDRFVAICHPLRYNVIMNPKLCGLLLLLSFIVSVLDALLHTLMVLQLTFCIDLEIPHFFCELAHILKLACSDVLINNILVYLVTSLLGVVPLSGIIFSYTRIVSSVMKIPSAGGKYKAFSICGSHLIVVSLFYGTGFGVYLSSGATHSSRKGAIASVMYTVVTPMLNPLIYSLRNKDMLKALRKLISRIPSFH

SEQ ID NO: 60026 - protein, 326 aa, Homo sapiens
  Payload ID: 11976
  Gene Symbol: OR8A1
  Gene Name: olfactory receptor, family 8, subfamily A, member 1
  Uniprot ID: Q8NGG7
  ENSP ID: ENSP00000284287
MGFLSPMHPCRPPTQRRMAAGNHSTVTEFILKGLTKRADLQLPLFLLFLGIYLVTIVGNLGMITLICLNSQLHTPMYYFLSNLSLMDLCYSSVITPKMLVNFVSEKNIISYAGCMSQLYFFLVFVIAECYMLTVMAYDRYVAICHPLLYNIIMSHHTCLLLVAVVYAIGLIGSTIETGLMLKLPYCEHLISHYFCDILPLMKLSCSSTYDVEMTVFFSAGFNIIVTSLTVLVSYTFILSSILGISTTEGRSKAFSTCSSHLAAVGMFYGSTAFMYLKPSTISSLTQENVASVFYTTVIPMLNPLIYSLRNKEVKAAVQKTLRGKLF

SEQ ID NO: 60027 - protein, 310 aa, Homo sapiens
  Payload ID: 11977
  Gene Symbol: OR8B12
  Gene Name: olfactory receptor, family 8, subfamily B, member 12
  Uniprot ID: Q8NGG6
  ENSP ID: ENSP00000307159
MAAKNSSVTEFILEGLTHQPGLRIPLFFLFLGFYTVTVVGNLGLITLIGLNSHLHTPMYFFLFNLSLIDFCFSTTITPKMLMSFVSRKNIISFTGCMTQLFFFCFFVVSESFILSAMAYDRYVAICNPLLYTVTMSCQVCLLLLLGAYGMGFAGAMAHTGSIMNLTFCADNLVNHFMCDILPLLELSCNSSYMNELVVFIVVAVDVGMPIVTVFISYALILSSILHNSSTEGRSKAFSTCSSHIIVVSLFFGSGAFMYLKPLSILPLEQGKVSSLFYTIIVPVLNPLIYSLRNKDVKVALRRTLGRKIFS

SEQ ID NO: 60028 - protein, 313 aa, Homo sapiens
  Payload ID: 11978
  Gene Symbol: OR8B2
  Gene Name: olfactory receptor, family 8, subfamily B, member 2
  Uniprot ID: Q96RD0
  ENSP ID: ENSP00000364152
MLARNNSLVTEFILAGLTDHPEFRQPLFFLFLVIYIVTMVGNLGLITLFGLNSHLHTPMYYFLFNLSFIDLCYSSVFTPKMLMNFVSKKNIISNVGCMTRLFFFLFFVISECYMLTSMAYDRYVAICNPLLYKVTMSHQVCSMLTFAAYIMGLAGATAHTGCMLRLTFCSANIINHYLCDILPLLQLSCTSTYVNEVVVLIVVGTNITVPSCTILISYVFIVTSILHIKSTQGRSKAFSTCSSHVIALSLFFGSAAFMYIKYSSGSMEQGKVSSVFYTNVVPMLNPLIYSLRNKDVKVALRKALIKIQRRNIF

SEQ ID NO: 60029 - protein, 313 aa, Homo sapiens
  Payload ID: 11979
  Gene Symbol: OR8B3
  Gene Name: olfactory receptor, family 8, subfamily B, member 3
  Uniprot ID: Q8NGG8
  ENSP ID: ENSP00000346611
MLARNNSLVTEFILAGLTDHPEFQQPLFFLFLVVYIVTMVGNLGLIILFGLNSHLHTPMYYFLFNLSFIDLCYSSVFTPKMLMNFVSKKNIISYVGCMTQLFFFLFFVISECYMLTSMAYDRYVAICNPLLYKVTMSHQVCSMLTFAAYIMGLAGATAHTGCMLRLTFCSANIINHYLCDILPLLQLSCTSTYVNEVVVLIVVGINIMVPSCTILISYVFIVTSILHIKSTQGRSKAFSTCSSHVIALSLFFGSAAFMYIKYSSGSMEQGKVSSVFYTNVVPMLNPLIYSLRNKDVKVALRKALIKIQRRNIF

SEQ ID NO: 60030 - protein, 309 aa, Homo sapiens; identical to SEQ ID NO: 59449
  Payload ID: 11980
  Gene Symbol: OR8B4
  Gene Name: olfactory receptor, family 8, subfamily B, member 4 (gene/pseudogene)
  Uniprot ID: Q96RC9
  ENSP ID: ENSP00000485212

SEQ ID NO: 60031 - protein, 311 aa, Homo sapiens
  Payload ID: 11981
  Gene Symbol: OR8B8
  Gene Name: olfactory receptor, family 8, subfamily B, member 8
  Uniprot ID: Q15620
  ENSP ID: ENSP00000330280
MAAENSSFVTQFILAGLTDQPGVQIPLFFLFLGFYVVTVVGNLGLITLIRLNSHLHTPMYFFLYNLSFIDFCYSSVITPKMLMSFVLKKNSISYAGCMTQLFFFLFFVVSESFILSAMAYDRYVAICNPLLYMVTMSPQVCFLLLLGVYGMGFAGAMAHTACMMGVTFCANNLVNHYMCDILPLLECACTSTYVNELVVFVVVGIDIGVPTVTIFISYALILSSIFHIDSTEGRSKAFSTCSSHIIAVSLFFGSGAFMYLKPFSLLAMNQGKVSSLFYTTVVPMLNPLIYSLRNKDVKVALKKILNKNAFS

SEQ ID NO: 60032 - protein, 308 aa, Homo sapiens
  Payload ID: 11982
  Gene Symbol: OR8D1
  Gene Name: olfactory receptor, family 8, subfamily D, member 1
  Uniprot ID: Q8WZ84
  ENSP ID: ENSP00000350474
MTMENYSMAAQFVLDGLTQQAELQLPLFLLFLGIYVVTVVGNLGMILLIAVSPLLHTPMYYFLSSLSFVDFCYSSVITPKMLVNFLGKKNTILYSECMVQLFFFVVFVVAEGYLLTAMAYDRYVAICSPLLYNAIMSSWVCSLLVLAAFFLGFLSALTHTSAMMKLSFCKSHIINHYFCDVLPLLNLSCSNTHLNELLLFIIAGFNTLVPTLAVAVSYAFILYSILHIRSSEGRSKAFGTCSSHLMAVVIFFGSITFMYFKPPSSNSLDQEKVSSVFYTTVIPMLNPLIYSLRNKDVKKALRKVLVGK

SEQ ID NO: 60033 - protein, 311 aa, Homo sapiens
  Payload ID: 11983
  Gene Symbol: OR8D2
  Gene Name: olfactory receptor, family 8, subfamily D, member 2 (gene/pseudogene)
  Uniprot ID: Q9GZM6
  ENSP ID: ENSP00000350022
MATSNHSSGAEFILAGLTQRPELQLPLFLLFLGIYVVTVVGNLGMIFLIALSSQLYPPVYYFLSHLSFIDLCYSSVITPKMLVNFVPEENIISFLECITQLYFFLIFVIAEGYLLTAMEYDRYVAICRPLLYNIVMSHRVCSIMMAVVYSLGFLWATVHTTRMSVLSFCRSHTVSHYFCDILPLLTLSCSSTHINEILLFIIGGVNTLATTLAVLISYAFIFSSILGIHSTEGQSKAFGTCSSHLLAVGIFFGSITFMYFKPPSSTTMEKEKVSSVFYITIIPMLNPLIYSLRNKDVKNALKKMTRGRQSS

SEQ ID NO: 60034 - protein, 311 aa, Homo sapiens; identical to SEQ ID NO: 60033
  Payload ID: 11983
  Gene Symbol: OR8D2
  Gene Name: olfactory receptor, family 8, subfamily D, member 2 (gene/pseudogene)
  Uniprot ID: Q9GZM6
  ENSP ID: ENSP00000485536

SEQ ID NO: 60035 - protein, 311 aa, Homo sapiens; identical to SEQ ID NO: 60033
  Payload ID: 11983
  Gene Symbol: OR8D2
  Gene Name: olfactory receptor, family 8, subfamily D, member 2 (gene/pseudogene)
  Uniprot ID: Q9GZM6
  ENSP ID: ENSP00000485661

SEQ ID NO: 60036 - protein, 314 aa, Homo sapiens
  Payload ID: 11984
  Gene Symbol: OR8D4
  Gene Name: olfactory receptor, family 8, subfamily D, member 4
  Uniprot ID: Q8NGM9
  ENSP ID: ENSP00000325381
MGVKNHSTVTEFLLSGLTEQAELQLPLFCLFLGIYTVTVVGNLSMISIIRLNRQLHTPMYYFLSSLSFLDFCYSSVITPKMLSGFLCRDRSISYSGCMIQLFFFCVCVISECYMLAAMACDRYVAICSPLLYRVIMSPRVCSLLVAAVFSVGFTDAVIHGGCILRLSFCGSNIIKHYFCDIVPLIKLSCSSTYIDELLIFVIGGFNMVATSLTIIISYAFILTSILRIHSKKGRCKAFSTCSSHLTAVLMFYGSLMSMYLKPASSSSLTQEKVSSVFYTTVILMLNPLIYSLRNNEVRNALMKLLRRKISLSPG

SEQ ID NO: 60037 - protein, 311 aa, Homo sapiens
  Payload ID: 11985
  Gene Symbol: OR8G1
  Gene Name: olfactory receptor, family 8, subfamily G, member 1 (gene/pseudogene)
  Uniprot ID: Q15617
  ENSP ID: ENSP00000476313
MSGENNSSVTEFILAGLSEQPELQLPLFLLFLGIYVVTVVGNLGMTTLIWLSSHLHTPMYYFLSSLSFIDFCHSTVITPKMLVNFVTEKNIISYPECMTQLYFFLVFAIAECHMLAAMAYDRYMAICSPLLYSVIISNKACFSLILGVYIIGLVCASVHTGCMFRVQFCKFDLINHYFCDLLPLLKLSCSSIYVNKLLILCVGAFNILVPSLTILCSYIFIIASILHIRSTEGRSKAFSTCSSHMLAVVIFFGSAAFMYLQPSSISSMDQGKVSSVFYTIIVPMLNPLIYSLRNKDVHVSLKKMLQRRTLL

SEQ ID NO: 60038 - protein, 346 aa, Homo sapiens
  Payload ID: 11986
  Gene Symbol: OR8G5
  Gene Name: olfactory receptor, family 8, subfamily G, member 5
  Uniprot ID: Q8NG78
  ENSP ID: ENSP00000477014
MIIYKQGITFLQKENNNTIHLNTMFFLSPAETHQRMAAENHSFVTKFILVGLTEKSELQLPLFLVFLGIYVVTVLGNLGMITLIGLSSHLHTPMYCFLSSLSFIDFCHSTVITPKMLVNFVTEKNIISYPECMTQLYFFLVFAIAECHMLAAMAYDGYVAICSPLLYSIIISNKACFSLILVVYVIGLICASAHIGCMFRVQFCKFDVINHYFCDLISILKLSCSSTYINELLILIFSGINILVPSLTILSSYIFIIASILRIRYTEGRSKAFSTCSSHISAVSVFFGSAAFMYLQPSSVSSMDQGKVSSVFYTIVVPMLNPLIYSLRNKDVHVALKKTLGKRTFL

SEQ ID NO: 60039 - protein, 311 aa, Homo sapiens
  Payload ID: 11987
  Gene Symbol: OR8H1
  Gene Name: olfactory receptor, family 8, subfamily H, member 1
  Uniprot ID: Q8NGG4
  ENSP ID: ENSP00000323595
MGRRNNTNVPDFILTGLSDSEEVQMALFILFLLIYLITMLGNVGMILIIRLDLQLHTPMYFFLTHLSFIDLSYSTVITPKTLANLLTSNYISFMGCFAQMFFFVFLGAAECFLLSSMAYDRYVAICSPLRYPVIMSKRLCCALVTGPYVISFINSFVNVVWMSRLHFCDSNVVRHFFCDTSPILALSCMDTYDIEIMIHILAGSTLMVSLITISASYVSILSTILKINSTSGKQKALSTCASHLLGVTIFYGTMIFTYLKPRKSYSLGRDQVASVFYTIVIPMLNPLIYSLRNKEVKNALIRVMQRRQDSR

SEQ ID NO: 60040 - protein, 309 aa, Homo sapiens
  Payload ID: 11987
  Gene Symbol: OR8H1
  Gene Name: olfactory receptor, family 8, subfamily H, member 1
  ENSP ID: ENSP00000460360
NNTNVPDFILTGLSDSEEVQMALFILFLLIYLITMLGNVGMILIIRLDLQLHTPMYFFLTHLSFIDLSYSTVITPKTLANLLTSNYISFMGCFAQMFFFVFLGAAECFLLSSMAYDRYVAICSPLRYPVIMSKRLCCALVTGPYVISFINSFVNVVWMSRLHFCDSNVVRHFFCDTSPILALSCMDTYDIEIMIHILAGSTLMVSLITISASYVSILSTILKINSTSGKQKALSTCASHLLGVTIFYGTMIFTYLKPRKSYSLGRDQVASVFYTIVIPMLNPLIYSLRNKEVKNALIRVMQRIWYVLGL

SEQ ID NO: 60041 - protein, 309 aa, Homo sapiens; identical to SEQ ID NO: 60040
  Payload ID: 11987
  Gene Symbol: OR8H1
  Gene Name: olfactory receptor, family 8, subfamily H, member 1
  ENSP ID: ENSP00000483372

SEQ ID NO: 60042 - protein, 311 aa, Homo sapiens; identical to SEQ ID NO: 60039
  Payload ID: 11987
  Gene Symbol: OR8H1
  Gene Name: olfactory receptor, family 8, subfamily H, member 1
  Uniprot ID: Q8NGG4
  ENSP ID: ENSP00000486842

SEQ ID NO: 60043 - protein, 312 aa, Homo sapiens
  Payload ID: 11988
  Gene Symbol: OR8H2
  Gene Name: olfactory receptor, family 8, subfamily H, member 2
  Uniprot ID: Q8N162
  ENSP ID: ENSP00000323982
MMGRRNNTNVADFILMGLTLSEEIQMALFMLFLLIYLITMLGNVGMILIIRLDLQLHTPMYFFLTHLSFIDLSYSTVVTPKTLANLLTSNYISFTGCFAQMFFFAFLGTAECYLLSSMAHDRYAAICSPLHYTVIMSKRLCLALITGPYVIGFIDSFVNVVSMSRLHFYDSNVIHHFFCDTSPILALSCTDTYNTEILIFIIVGSTLMVSLFTISASYVFILFTILKINSTSGKQKAFSTCVSHLLGVTIFYSTLIFTYLKPRKSYSLGRDQVASVFYTIVIPVLNPLIYSLRNKEVKNAVIRVMQRRQDSR

SEQ ID NO: 60044 - protein, 311 aa, Homo sapiens
  Payload ID: 11988
  Gene Symbol: OR8H2
  Gene Name: olfactory receptor, family 8, subfamily H, member 2
  ENSP ID: ENSP00000482661
MGRRNNTNVADFILMGLTLSEEIQMALFMLFLLIYLITMLGNVGMILIIRLDLQLHTPMYFFLTHLSFIDLSYSTVVTPKTLANLLTSNYISFTGCFAQMFFFAFLGTAECYLLSSMAHDRYAAICSPLHYTVIMSKRLCLALITGPYVIGFIDSFVNVVSMSRLHFYDSNVIHHFFCDTSPILALSCTDTYNTEILIFIIVGSTLMVSLFTISASYVFILFTILKINSTSGKQKAFSTCVSHLLGVTIFYSTLIFTYLKPRKSYSLGRDQVASVFYTIVIPVLNPLIYSLRNKEVKNAVIRVMQRRQDSR

SEQ ID NO: 60045 - protein, 312 aa, Homo sapiens
  Payload ID: 11989
  Gene Symbol: OR8H3
  Gene Name: olfactory receptor, family 8, subfamily H, member 3
  Uniprot ID: Q8N146
  ENSP ID: ENSP00000323928
MMGRRNDTNVADFILTGLSDSEEVQMALFMLFLLIYLITMLGNVGMLLIIRLDLQLHTPMYFFLTHLSFIDLSYSTVVTPKTLANLLTSNYISFTGCFAQMFCFVFLGTAECYLLSSMAYDRYAAICSPLHYTVIMPKRLCLALITGPYVIGFMDSFVNVVSMSRLHFCDSNIIHHFFCDTSPILALSCTDTDNTEMLIFIIAGSTLMVSLITISASYVSILSTILKINSTSGKQKAFSTCVSHLLGVTIFYGTMIFTYLKPRKSYSLGRDQVAPVFYTIVIPMLNPLIYSLRNREVKNALIRVMQRRQDSR

SEQ ID NO: 60046 - protein, 310 aa, Homo sapiens
  Payload ID: 11990
  Gene Symbol: OR8I2
  Gene Name: olfactory receptor, family 8, subfamily I, member 2
  Uniprot ID: Q8N0Y5
  ENSP ID: ENSP00000303864
MAGNNFTEVTVFILSGFANHPELQVSLFLMFLFIYLFTVLGNLGLITLIRMDSQLHTPMYFFLSNLAFIDIFYSSTVTPKALVNFQSNRRSISFVGCFVQMYFFVGLVCCECFLLGSMAYNRYIAICNPLLYSVVMSQKVSNWLGVMPYVIGFTSSLISVWVISSLAFCDSSINHFFCDTTALLALSCVDTFGTEMVSFVLAGFTLLSSLLIITVTYIIIISAILRIQSAAGRQKAFSTCASHLMAVTIFYGSLIFTYLQPDNTSSLTQAQVASVFYTIVIPMLNPLIYSLRNKDVKNALLRVIHRKLFP

SEQ ID NO: 60047 - protein, 184 aa, Homo sapiens
  Payload ID: 11990
  Gene Symbol: OR8I2
  Gene Name: olfactory receptor, family 8, subfamily I, member 2
  ENSP ID: ENSP00000482751
MAGNNFTEVTVFILSGFANHPELQVSLFLMFLFIYLFTVLGNLGLITLIRMDSQLHTPMYFFLSNLAFIDIFYSSTVTPKALVNFQSNRRSISFVGCFVQMYFFVGLVCCECFLLGSMAYNRYIAICNPLLYSVVMSQKVSNWLGVMPYVIGFTSSLISVWVISSLAFCDSSINHFFCDTTALL

SEQ ID NO: 60048 - protein, 316 aa, Homo sapiens
  Payload ID: 11991
  Gene Symbol: OR8J1
  Gene Name: olfactory receptor, family 8, subfamily J, member 1
  Uniprot ID: Q8NGP2
  ENSP ID: ENSP00000304060
MAPENFTRVTEFILTGVSSCPELQIPLFLVFLVLYGLTMAGNLGIITLTSVDSRLQTPMYFFLQHLALINLGNSTVIAPKMLINFLVKKKTTSFYECATQLGGFLFFIVSEVIMLALMAYDRYVAICNPLLYMVVVSRRLCLLLVSLTYLYGFSTAIVVSSYVFSVSYCSSNIINHFYCDNVPLLALSCSDTYLPETVVFISAATNVVGSLIIVLVSYFNIVLSILKICSSEGRKKAFSTCASHMMAVTIFYGTLLFMYVQPRSNHSLDTDDKMASVFYTLVIPMLNPLIYSLRNKDVKTALQRFMTNLCYSFKTM

SEQ ID NO: 60049 - protein, 316 aa, Homo sapiens; identical to SEQ ID NO: 60048
  Payload ID: 11991
  Gene Symbol: OR8J1
  Gene Name: olfactory receptor, family 8, subfamily J, member 1
  Uniprot ID: Q8NGP2
  ENSP ID: ENSP00000460206

SEQ ID NO: 60050 - protein, 314 aa, Homo sapiens
  Payload ID: 11992
  Gene Symbol: OR8J2
  Gene Name: olfactory receptor, family 8, subfamily J, member 2 (gene/pseudogene)
  ENSP ID: ENSP00000477259
MASGNLTWVTEFILVGVSDDPELQIPLFLVFLVLYLLTVAGNLGIITLTSVDPQLQTPMYFFLHLAIINLCNSTVVAPKMLVNFLVTKKTISYYGCAAQLGGFLVFIVAEIFTLAAMAYDRYVAIWSPLLYAVVVSPKVCRLLVSLTYLQSLITALTVSSCVFSVSYCSSNIINHFYCDDVPLLALSCSDTYIPETAVFIFSGTNLLFSMIVVLISYFNIVITILRIRSSEGRQKAFSTCASHMIAVVVFYGTLLFMYLQPRSNHSLDTDKMASVFYTLVIPVLNPLIYSLRNKNVKDALKRFLDNPCRSLKLM

SEQ ID NO: 60051 - protein, 314 aa, Homo sapiens; identical to SEQ ID NO: 60050
  Payload ID: 11992
  Gene Symbol: OR8J2
  Gene Name: olfactory receptor, family 8, subfamily J, member 2 (gene/pseudogene)
  ENSP ID: ENSP00000485975

SEQ ID NO: 60052 - protein, 315 aa, Homo sapiens
  Payload ID: 11993
  Gene Symbol: OR8J3
  Gene Name: olfactory receptor, family 8, subfamily J, member 3
  Uniprot ID: Q8NGG0
  ENSP ID: ENSP00000301529
MAPENFTRVTEFILTGVSSCPELQIPLFLVFLVLYVLTMAGNLGIITLTSVDSRLQNPMYFFLRHLAIINLGNSTVIAPKMLMNFLVKKKTTSFYECATQLGGFLFFIVSEVMMLAVMAYDRYVAICNPLLYMVVVSRRLCLLLVSLTYLYGFSTAIVVSPCIFSVSYCSSNIINHFYCDIAPLLALSCSDTYIPETIVFISAATNLVFSMITVLVSYFNIVLSILRIRSPEGRKKAFSTCASHMIAVTVFYGTMLFMYLQPQTNHSLDTDKMASVFYTLVIPMLNPLIYSLRNNDVNVALKKFMENPCYSFKSM

SEQ ID NO: 60053 - protein, 319 aa, Homo sapiens
  Payload ID: 11994
  Gene Symbol: OR8K1
  Gene Name: olfactory receptor, family 8, subfamily K, member 1
  Uniprot ID: Q8NGG5
  ENSP ID: ENSP00000279783
MNHVVKHNHTAVTKVTEFILMGITDNPGLQAPLFGLFLIIYLVTVIGNLGMVILTYLDSKLHTPMYFFLRHLSITDLGYSTVIAPKMLVNFIVHKNTISYNWYATQLAFFEIFIISELFILSAMAYDRYVAICKPLLYVIIMAEKVLWVLVIVPYLYSTFVSLFLTIKLFKLSFCGSNIISYFYCDCIPLMSILCSDTNELELIILIFSGCNLLFSLSIVLISYMFILVAILRMNSRKGRYKAFSTCSSHLTVVIMFYGTLLFIYLQPKSSHTLAIDKMASVFYTLLIPMLNPLIYSLRNKEVKDALKRTLTNRFKIPI

SEQ ID NO: 60054 - protein, 319 aa, Homo sapiens; identical to SEQ ID NO: 60053
  Payload ID: 11994
  Gene Symbol: OR8K1
  Gene Name: olfactory receptor, family 8, subfamily K, member 1
  Uniprot ID: Q8NGG5
  ENSP ID: ENSP00000461384

SEQ ID NO: 60055 - protein, 312 aa, Homo sapiens
  Payload ID: 11995
  Gene Symbol: OR8K3
  Gene Name: olfactory receptor, family 8, subfamily K, member 3 (gene/pseudogene)
  Uniprot ID: Q8NH51
  ENSP ID: ENSP00000323555
MEQHNLTTVNEFILTGITDIAELQAPLFALFLMIYVISVMGNLGMIVLTKLDSRLQTPMYFFLRHLAFMDLGYSTTVGPKMLVNFVVDKNIISYYFCATQLAFFLVFIGSELFILSAMSYDLYVAICNPLLYTVIMSRRVCQVLVAIPYLYCTFISLLVTIKIFTLSFCGYNVISHFYCDSLPLLPLLCSNTHEIELIILIFAAIDLISSLLIVLLSYLLILVAILRMNSAGRQKAFSTCGAHLTVVIVFYGTLLFMYVQPKSSHSFDTDKVASIFYTLVIPMLNPLIYSLRNKDVKYALRRTWNNLCNIFV

SEQ ID NO: 60056 - protein, 312 aa, Homo sapiens; identical to SEQ ID NO: 60055
  Payload ID: 11995
  Gene Symbol: OR8K3
  Gene Name: olfactory receptor, family 8, subfamily K, member 3 (gene/pseudogene)
  Uniprot ID: Q8NH51
  ENSP ID: ENSP00000460880

SEQ ID NO: 60057 - protein, 312 aa, Homo sapiens; identical to SEQ ID NO: 60055
  Payload ID: 11995
  Gene Symbol: OR8K3
  Gene Name: olfactory receptor, family 8, subfamily K, member 3 (gene/pseudogene)
  Uniprot ID: Q8NH51
  ENSP ID: ENSP00000485070

SEQ ID NO: 60058 - protein, 312 aa, Homo sapiens; identical to SEQ ID NO: 60055
  Payload ID: 11995
  Gene Symbol: OR8K3
  Gene Name: olfactory receptor, family 8, subfamily K, member 3 (gene/pseudogene)
  Uniprot ID: Q8NH51
  ENSP ID: ENSP00000485634

SEQ ID NO: 60059 - protein, 307 aa, Homo sapiens
  Payload ID: 11996
  Gene Symbol: OR8K5
  Gene Name: olfactory receptor, family 8, subfamily K, member 5
  Uniprot ID: Q8NH50
  ENSP ID: ENSP00000323853
MGQHNLTVLTEFILMELTRRPELQIPLFGVFLVIYLITVVGNLTMIILTKLDSHLHTPMYFSIRHLAFVDLGNSTVICPKVLANFVVDRNTISYYACAAQLAFFLMFIISEFFILSAMAYDRYVAICNPLLYYVIMSQRLCHVLVGIQYLYSTFQALMFTIKIFTLTFCGSNVISHFYCDDVPLLPMLCSNAQEIELLSILFSVFNLISSFLIVLVSYMLILLAICQMHSAEGRKKAFSTCGSHLTVVVVFYGSLLFMYMQPNSTHFFDTDKMASVFYTLVIPMLNPLIYSLRNEEVKNAFYKLFEN

SEQ ID NO: 60060 - protein, 359 aa, Homo sapiens
  Payload ID: 11997
  Gene Symbol: OR8S1
  Gene Name: olfactory receptor, family 8, subfamily S, member 1
  Uniprot ID: Q8NH09
  ENSP ID: ENSP00000310632
MALGNHSTITEFLLLGLSADPNIRALLFVLFLGIYLLTIMENLMLLLMIRADSCLHKPMYFFLSHLSFVDLCFSSVIVPKMLENLLSQRKTISVEGCLAQVFFVFVTAGTEACLLSGMAYDRHAAICRPLLYGQIMGKQLYMHLVWGSWGLGFLDALINVLLAVNMVFCEAKIIHHYSYEMPSLLPLSCSDISRSLIALLCSTLLHGLGNFLLVFLSYTRIISTILSISSTSGRSKAFSTCSAHLTAVTLYYGSGLLRHLMPNSGSPIELIFSVQYTVVTPMLNSLIYSLKNKEVKGERSLRDSSHLPQLHKGQARWKRPAFTEGRREPGHPELSIPVTPQPQGACACSALRAAPTALP

SEQ ID NO: 60061 - protein, 309 aa, Homo sapiens
  Payload ID: 11998
  Gene Symbol: OR8U1
  Gene Name: olfactory receptor, family 8, subfamily U, member 1
  Uniprot ID: Q8NH10
  ENSP ID: ENSP00000304188
MAHINCTQATEFILVGLTDHQELKMPLFVLFLSIYLFTVVGNLGLILLIRADTSLNTPMYFFLSNLAFVDFCYSSVITPKMLGNFLYKQNVISFDACATQLGCFLTFMISESLLLASMAYDRYVAICNPLLYMVVMTPGICIQLVAVPYSYSFLMALFHTILTFRLSYCHSNIVNHFYCDDMPLLRLTCSDTRFKQLWIFACAGIMFISSLLIVFVSYMFIISAILRMHSAEGRQKAFSTCGSHMLAVTIFYGTLIFMYLQPSSSHALDTDKMASVFYTVIIPMLNPLIYSLQNKEVKEALKKIIINKN

SEQ ID NO: 60062 - protein, 309 aa, Homo sapiens
  Payload ID: 11998
  Gene Symbol: OR8U1
  Gene Name: olfactory receptor, family 8, subfamily U, member 1
  Uniprot ID: P0C7N5
  ENSP ID: ENSP00000487204
MTQINCTQVTEFILVGLTDRQELKMPLFVLFLSIYLFTVVGNLGLILLIRTDEKLNTPMYFFLSNLAFVDFCYSSVITPKMLGNFLYKQNSISFNACAAQLGCFLAFMTAECLLLASMAYDRYVAICNPLMYMVVMSPGICIQLVAAPHSYSILVALFHTILTFRLSYCHSNIVNHFYCDDMPLLRLTCSDTRFKQLWIFACAGIMFISSLLIVFVSYMFIISAILRMHSAEGRQKAFSTCGSHMLAVTIFYGTLIFMYLQPSSSHALDTDKMASVFYTVIIPMLNPLIYSLQNKEVKEALKKIIINKN

SEQ ID NO: 60063 - protein, 309 aa, Homo sapiens [sequence omitted]

SEQ ID NO: 60064 - protein, 319 aa, Homo sapiens
  Payload ID: 11999
  Gene Symbol: OR8U8
  Gene Name: olfactory receptor, family 8, subfamily U, member 8
  ENSP ID: ENSP00000486165
MAHINCTQATEFILVGLTDRQELKMPLFVLFLSIYLFTVVGNLGLILLIRADTSLNTPMYFFLSNLAFVDFCYSSVITPKMLGNFLYKQNVISFDACATQLGCFLTFMISESLLLASMAYDRYVAICNPLLYMVVMTPGICIQLVAVPYSYSFLMALFHTILTFCLSYCHSNIVNHFYCDDMPLLRLTCSDTRFKQLWILACAGITFICSVLIVFVSYMFIIFAILRMSSAEGRRKAFSTCSSHMLAVTIFYGTLIFMYLQPSSSHSLDADKMASVFYTVIIPMLNPLIYSLRNKDVKDALKKVIINRNHAFIFLKLRK

SEQ ID NO: 60065 - protein, 310 aa, Homo sapiens
  Payload ID: 12000
  Gene Symbol: OR9A2
  Gene Name: olfactory receptor, family 9, subfamily A, member 2
  Uniprot ID: Q8NGT5
  ENSP ID: ENSP00000316518
MMDNHSSATEFHLLGFPGSQGLHHILFAIFFFFYLVTLMGNTVIIVIVCVDKRLQSPMYFFLSHLSTLEILVTTIIVPMMLWGLLFLGCRQYLSLHVSLNFSCGTMEFALLGVMAVDRYVAVCNPLRYNIIMNSSTCIWVVIVSWVFGFLSEIWPIYATFQFTFRKSNSLDHFYCDRGQLLKLSCDNTLLTEFILFLMAVFILIGSLIPTIVSYTYIISTILKIPSASGRRKAFSTFASHFTCVVIGYGSCLFLYVKPKQTQGVEYNKIVSLLVSVLTPFLNPFIFTLRNDKVKEALRDGMKRCCQLLKD

SEQ ID NO: 60066 - protein, 310 aa, Homo sapiens; identical to SEQ ID NO: 60065
  Payload ID: 12000
  Gene Symbol: OR9A2
  Gene Name: olfactory receptor, family 9, subfamily A, member 2
  Uniprot ID: Q8NGT5
  ENSP ID: ENSP00000479412

SEQ ID NO: 60067 - protein, 314 aa, Homo sapiens
  Payload ID: 12001
  Gene Symbol: OR9A4
  Gene Name: olfactory receptor, family 9, subfamily A, member 4
  Uniprot ID: Q8NGU2
  ENSP ID: ENSP00000448789
MLMNYSSATEFYLLGFPGSEELHHILFAIFFFFYLVTLMGNTVIIMIVCVDKRLQSPMYFFLGHLSALEILVTTIIVPVMLWGLLLPGMQTIYLSACVVQLFLYLAVGTTEFALLGAMAVDRYVAVCNPLRYNIIMNRHTCNFVVLVSWVFGFLFQIWPVYVMFQLTYCKSNVVNNFFCDRGQLLKLSCNNTLFTEFILFLMAVFVLFGSLIPTIVSNAYIISTILKIPSSSGRRKSFSTCASHFTCVVIGYGSCLFLYVKPKQTQAADYNWVVSLMVSVVTPFLNPFIFTLRNDKVIEALRDGVKRCCQLFRN

SEQ ID NO: 60068 - protein, 305 aa, Homo sapiens
  Payload ID: 12002
  Gene Symbol: OR9G1
  Gene Name: olfactory receptor, family 9, subfamily G, member 1
  Uniprot ID: Q8NH87
  ENSP ID: ENSP00000309012
MQRSNHTVTEFILLGFTTDPGMQLGLFVVFLGVYSLTVVGNSTLIVLICNDSCLHTPMYFFTGNLSFLDLWYSSVYTPKILVTCISEDKSISFAGCLCQFFFSAGLAYSECYLLAAVAYDRYVAISKPLLYAQAMSIKLCALLVAVSYCGGFINSSIITKKTFSFNFCRENIIDDFFCDLLPLVELACGEKGGYKIMMYFLLASNVICPAVLILASYLFIITSVLRISSSKGYLKAFSTCSSHLTSVTLYYGSILYIYALPRSSYSFDMDKIVSTFYTVVFPMLNLMIYSLRNKDVKEALKKLLP

SEQ ID NO: 60069 - protein, 305 aa, Homo sapiens
  Payload ID: 12002
  Gene Symbol: OR9G1
  Gene Name: olfactory receptor, family 9, subfamily G, member 1
  ENSP ID: ENSP00000461395
MQRSNHTVTEFILLGFTTDPGMQLGLFVVFLGVYSLTVVGNSTLIVLICNDSRLHTPMYFFIGNLSFLDLWYSSVYTPKILVTCISEDKSISFAGCLGQFFFSAGLAYSECYLLAAVAYDRYVAISKPLLYAQAMSIKLCALLVAVSYCGGFINSSIITKKTFSFNFCRENIIDDFFCDLLPLVELACGEKGGYKIMMYFLLASNVICPAVLILASYLFIITSVLRISSSQGRLKAFSTCSSHLTSVTLYYGSILYIYALPRSSYSFDMDKIVSTFYTVVFPMLNLMIYSLRNKDVKEALKKLLP

SEQ ID NO: 60070 - protein, 327 aa, Homo sapiens
  Payload ID: 12003
  Gene Symbol: OR9G4
  Gene Name: olfactory receptor, family 9, subfamily G, member 4
  Uniprot ID: Q8NGQ1
  ENSP ID: ENSP00000307515
MIFPSHDSQAFTSVDMEVGNCTILTEFILLGFSADSQWQPILFGVFLMLYLITLSGNMTLVILIRTDSHLHTPMYFFIGNLSFLDFWYTSVYTPKILASCVSEDKRISLAGCGAQLFFSCVVAYTECYLLAAMAYDRHAAICNPLLYSGTMSTALCTGLVAGSYIGGFLNAIAHTANTFRLHFCGKNIIDHFFCDAPPLVKMSCTNTRVYEKVLLGVVGFTVLSSILAILISYVNILLAILRIHSASGRHKAFSTCASHLISVMLFYGSLLFMYSRPSSTYSLERDKVAALFYTVINPLLNPLIYSLRNKDIKEAFRKATQTIQPQT

SEQ ID NO: 60071 - protein, 327 aa, Homo sapiens; identical to SEQ ID NO: 60070
  Payload ID: 12003
  Gene Symbol: OR9G4
  Gene Name: olfactory receptor, family 9, subfamily G, member 4
  Uniprot ID: Q8NGQ1
  ENSP ID: ENSP00000459325

SEQ ID NO: 60072 - protein, 305 aa, Homo sapiens
  Payload ID: 12004
  Gene Symbol: OR9G9
  Gene Name: olfactory receptor, family 9, subfamily G, member 9
  ENSP ID: ENSP00000458970
MQRSNHTVTEFILLGFTTDPGMQLGLFVVFLGVYSLTVVGNSTLIVLICNDSHLHTPMYFVVGNLSFLDLWYSSVYTPKILVICISEDKSISFAGCLCQFFFSAGLAYSECCLLAAMAYDRYVAISKPLLYAQAMSIKLCALLVAVSYCGGFINSSIITKKTFSFNFCCENIIDDFFCDLLPLVKLACGEKGGYKFLMYFLLASNVICPAVLILASYLFIITSVLRISSSQGRLKAFSTCSSHLTSVTLYYGSILYIYALPRSSYSFDMDKIVSTFYTEVLPMLNPMIYSLRNKDVKEALKKLLP

SEQ ID NO: 60073 - protein, 314 aa, Homo sapiens
  Payload ID: 12005
  Gene Symbol: OR9I1
  Gene Name: olfactory receptor, family 9, subfamily I, member 1
  Uniprot ID: Q8NGQ6
  ENSP ID: ENSP00000302606
MAKNNLTRVTEFILMGFMDHPKLEIPLFLVFLSFYLVTLLGNVGMIMLIQVDVKLYTPMYFFLSHLSLLDACYTSVITPQILATLATGKTVISYGHCAAQFFLFTICAGTECFLLAVMAYDRYAAIRNPLLYTVAMNPRLCWSLVVGAYVCGVSGAILRTTCTFTLSFCKDNQINFFFCDLPPLLKLACSDTANIEIVIIFFGNFVILANASVILISYLLIIKTILKVKSSGGRAKTFSTCASHITAVALFFGALIFMYLQSGSGKSLEEDKVVSVFYTVVIPMLNPLIYSLRNKDVKDAFRKVARRLQVSLSM

SEQ ID NO: 60074 - protein, 335 aa, Homo sapiens
  Payload ID: 12006
  Gene Symbol: OR9K2
  Gene Name: olfactory receptor, family 9, subfamily K, member 2
  Uniprot ID: Q8NGE7
  ENSP ID: ENSP00000307598
MLGSKPRVHLYILPCASQQVSTMGDRGTSNHSEMTDFILAGFRVRPELHILLFLLFLFVYAMILLGNVGMMTIIMTDPRLNTPMYFFLGNLSFIDLFYSSVIEPKAMINFWSENKSISFAGCVAQLFLFALLIVTEGFLLAAMAYDRFIAICNPLLYSVQMSTRLCTQLVAGSYFCGCISSVIQTSMTFTLSFCASRAVDHFYCDSRPLQRLSCSDLFIHRMISFSLSCIIILPTIIVIIVSYMYIVSTVLKIHSTEGHKKAFSTCSSHLGVVSVLYGAVFFMYLTPDRFPELSKVASLCYSLVTPMLNPLIYSLRNKDVQEALKKFLEKKNIIL

SEQ ID NO: 60075 - protein, 310 aa, Homo sapiens
  Payload ID: 12007
  Gene Symbol: OR9Q1
  Gene Name: olfactory receptor, family 9, subfamily Q, member 1
  Uniprot ID: Q8NGQ5
  ENSP ID: ENSP00000334934
MAEMNLTLVTEFLLIAFTEYPEWALPLFLLFLFMYLITVLGNLEMIILILMDHQLHAPMYFLLSHLAFMDVCYSSITVPQMLAVLLEHGAALSYTRCAAQFFLFTFFGSIDCYLLALMAYDRYLAVCQPLLYVTILTQQARLSLVAGAYVAGLISALVRTVSAFTLSFCGTSEIDFIFCDLPPLLKLTCGESYTQEVLIIMFAIFVIPASMVVILVSYLFIIVAIMGIPAGSQAKTFSTCTSHLTAVSLFFGTLIFMYLRGNSDQSSEKNRVVSVLYTEVIPMLNPLIYSLRNKEVKEALRKILNRAKLS

SEQ ID NO: 60076 - protein, 310 aa, Homo sapiens; identical to SEQ ID NO: 60075
  Payload ID: 12007
  Gene Symbol: OR9Q1
  Gene Name: olfactory receptor, family 9, subfamily Q, member 1
  Uniprot ID: Q8NGQ5
  ENSP ID: ENSP00000479549

SEQ ID NO: 60077 - protein, 314 aa, Homo sapiens
  Payload ID: 12008
  Gene Symbol: OR9Q2
  Gene Name: olfactory receptor, family 9, subfamily Q, member 2
  Uniprot ID: Q8NGE9
  ENSP ID: ENSP00000308714
MAERNYTVVTEFFLTAFTEHLQWRVPLFLIFLSFYLATMLGNTGMILLIRGDRRLHTPMYFFLSHLSLVDICYSSAIIPQMLAVLWEHGTTISQARCAAQFFLFTFFASIDCYLLAIMAYDRYTAVCQPLLYVTIITEKARWGLVTGAYVAGFFSAFVRTVTAFTLSFCGNNEINFIFCDLPPLLKLSCGDSYTQEVVIIVFALFVMPACILVILVSYLFIIVAILQIHSAGGRAKTFSTCASHLTAVALFFGTLIFMYLRDNTGQSSEGDRVVSVLYTVVTPMLNPLIYSLRNKEVKEATRKALSKSKPARRP

SEQ ID NO: 60078 - protein, 323 aa, Homo sapiens
  Payload ID: 12009
  Gene Symbol: OLIG2
  Gene Name: oligodendrocyte lineage transcription factor 2
  Uniprot ID: Q13516
  ENSP ID: ENSP00000331040
MDSDASLVSSRPSSPEPDDLFLPARSKGSSGSAFTGGTVSSSTPSDCPPELSAELRGAMGSAGAHPGDKLGGSGFKSSSSSTSSSTSSAAASSTKKDKKQMTEPELQQLRLKINSRERKRMHDLNIAMDGLREVMPYAHGPSVRKLSKIATLLLARNYILMLTNSLEEMKRLVSEIYGGHHAGFHPSACGGLAHSAPLPAATAHPAAAAHAAHHPAVHHPILPPAAAAAAAAAAAAAVSSASLPGSGLPSVGSIRPPHGLLKSPSAAAAAPLGGGGGGSGASGGFQHWGGMPCPCSMCQVPPPHHHVSAMGAGSLPRLTSDAK

SEQ ID NO: 60079 - protein, 323 aa, Homo sapiens; identical to SEQ ID NO: 60078
  Payload ID: 12009
  Gene Symbol: OLIG2
  Gene Name: oligodendrocyte lineage transcription factor 2
  Uniprot ID: Q13516
  ENSP ID: ENSP00000371794

SEQ ID NO: 60080 - protein, 62 aa, Homo sapiens
  Payload ID: 12009
  Gene Symbol: OLIG2
  Gene Name: oligodendrocyte lineage transcription factor 2
  ENSP ID: ENSP00000391183
MDSDASLVSSRPSSPEPDDLFLPARSKGSSGSAFTGGTVSSSTPSDCPPELSAELRGAMGSA

SEQ ID NO: 60081 - protein, 440 aa, Homo sapiens
  Payload ID: 12010
  Gene Symbol: OMG
  Gene Name: oligodendrocyte myelin glycoprotein
  Uniprot ID: P23515
  ENSP ID: ENSP00000247271
MEYQILKMSLCLFILLFLTPGILCICPLQCICTERHRHVDCSGRNLSTLPSGLQENIIHLNLSYNHFTDLHNQLTQYTNLRTLDISNNRLESLPAHLPRSLWNMSAANNNIKLLDKSDTAYQWNLKYLDVSKNMLEKVVLIKNTLRSLEVLNLSSNKLWTVPTNMPSKLHIVDLSNNSLTQILPGTLINLTNLTHLYLHNNKFTFIPDQSFDQLFQLQEITLYNNRWSCDHKQNITYLLKWMMETKAHVIGTPCSTQISSLKEHNMYPTPSGFTSSLFTVSGMQTVDTINSLSVVTQPKVTKIPKQYRTKETTFGATLSKDTTFTSTDKAFVPYPEDTSTETINSHEAAAATLTIHLQDGMVTNTSLTSSTKSSPTPMTLSITSGMPNNFSEMPQQSTTLNLWREETTTNVKTPLPSVANAWKVNASFLLLLNVVVMLAV

SEQ ID NO: 60082 - protein, 271 aa, Homo sapiens
  Payload ID: 12011
  Gene Symbol: OLIG1
  Gene Name: oligodendrocyte transcription factor 1
  Uniprot ID: Q8TAK6
  ENSP ID: ENSP00000371785
MYYAVSQARVNAVPGTMLRPQRPGDLQLGASLYELVGYRQPPSSSSSSTSSTSSTSSSSTTAPLLPKAAREKPEAPAEPPGPGPGSGAHPGGSARPDAKEEQQQQLRRKINSRERKRMQDLNLAMDALREVILPYSAAHCQGAPGRKLSKIATLLLARNYILLLGSSLQELRRALGEGAGPAAPRLLLAGLPLLAAAPGSVLLAPGAVGPPDALRPAKYLSLALDEPPCGQFALPGGGAGGPGLCTCAVCKFPHLVPASLGLAAVQAQFSK

SEQ ID NO: 60083 - protein, 32 aa, Homo sapiens
  Payload ID: 12011
  Gene Symbol: OLIG1
  Gene Name: oligodendrocyte transcription factor 1
  ENSP ID: ENSP00000414840
  MOD_RES (1)..(1): Any amino acid
XGPGLCTCAVCKFPHLVPASLGLAAVQAQFSK

SEQ ID NO: 60084 - protein, 272 aa, Homo sapiens
  Payload ID: 12012
  Gene Symbol: OLIG3
  Gene Name: oligodendrocyte transcription factor 3
  Uniprot ID: Q7RTU3
  ENSP ID: ENSP00000356708
MNSDSSSVSSRASSPDMDEMYLRDHHHRHHHHQESRLNSVSSTQGDMMQKMPGESLSRAGAKAAGESSKYKIKKQLSEQDLQQLRLKINGRERKRMHDLNLAMDGLREVMPYAHGPSVRKLSKIATLLLARNYILMLTSSLEEMKRLVGEIYGGHHSAFHCGTVGHSAGHPAHAANSVHPVHPILGGALSSGNASSPLSAASLPAIGTIRPPHSLLKAPSTPPALQLGSGFQHWAGLPCPCTICQMPPPPHLSALSTANMARLSAESKDLLK

SEQ ID NO: 60085 - protein, 141 aa, Homo sapiens
  Payload ID: 12013
  Gene Symbol: OPALIN
  Gene Name: oligodendrocytic myelin paranodal and inner loop protein
  Uniprot ID: Q96PE5
  ENSP ID: ENSP00000360214
MSFSLNFTLPANTTSSPVTGGKETDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 60086 - protein, 129 aa, Homo sapiens
  Payload ID: 12013
  Gene Symbol: OPALIN
  Gene Name: oligodendrocytic myelin paranodal and inner loop protein
  ENSP ID: ENSP00000377448
MTSSPVTGGKETDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 60087 - protein, 118 aa, Homo sapiens
  Payload ID: 12013
  Gene Symbol: OPALIN
  Gene Name: oligodendrocytic myelin paranodal and inner loop protein
  Uniprot ID: Q96PE5
  ENSP ID: ENSP00000377449
MDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 60088 - protein, 130 aa, Homo sapiens
  Payload ID: 12013
  Gene Symbol: OPALIN
  Gene Name: oligodendrocytic myelin paranodal and inner loop protein
  Uniprot ID: Q96PE5
  ENSP ID: ENSP00000398025
MSFSLNFTLPANTDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 60089 - protein, 79 aa, Homo sapiens
  Payload ID: 12013
  Gene Symbol: OPALIN
  Gene Name: oligodendrocytic myelin paranodal and inner loop protein
  ENSP ID: ENSP00000445125
MEESDRPCEISEIDDNPKISENPRRSPTHEKNTMGAQEAHIYVKTVAGSEEPVHDRYRPTIEMERRRGLWWLVPRLSLE

SEQ ID NO: 60090 - protein, 131 aa, Homo sapiens
  Payload ID: 12013
  Gene Symbol: OPALIN
  Gene Name: oligodendrocytic myelin paranodal and inner loop protein
  Uniprot ID: Q96PE5
  ENSP ID: ENSP00000484599
MRMTSSPVTGGKETDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 60091 - protein, 368 aa, Homo sapiens
  Payload ID: 12014
  Gene Symbol: OBFC1
  Gene Name: oligonucleotide/oligosaccharide-binding fold containing 1
  Uniprot ID: Q9H668
  ENSP ID: ENSP00000224950
MQPGSSRCEEETPSLLWGLDPVFLAFAKLYIRDILDMKESRQVPGVFLYNGHPIKQVDVLGTVIGVRERDAFYSYGVDDSTGVINCICWKKLNTESVSAAPSAARELSLTSQLKKLQETIEQKTKIEIGDTIRVRGSIRTYREEREIHATTYYKVDDPVWNIQIARMLELPTIYRKVYDQPFHSSALEKEEALSNPGALDLPSLTSLLSEKAKEFLMENRVQSFYQQELEMVESLLSLANQPVIHSASSDQVNFKKDTTSKAIHSIFKNAIQLLQEKGLVFQKDDGFDNLYYVTREDKDLHRKIHRIIQQDCQKPNHMEKGCHFLHILACARLSIRPGLSEAVLQQVLELLEDQSDIVSTMEHYYTAF

SEQ ID NO: 60092 - protein, 368 aa, Homo sapiens; identical to SEQ ID NO: 60091
  Payload ID: 12014
  Gene Symbol: OBFC1
  Gene Name: oligonucleotide/oligosaccharide-binding fold containing 1
  Uniprot ID: Q9H668
  ENSP ID: ENSP00000358779

SEQ ID NO: 60093 - protein, 802 aa, Homo sapiens
  Payload ID: 12015
  Gene Symbol: OPHN1
  Gene Name: oligophrenin 1
  Uniprot ID: O60890
  ENSP ID: ENSP00000347710
MGHPPLEFSDCYLDSPDFRERLKCYEQELERTNKFIKDVIKDGNALISAMRNYSSAVQKFSQTLQSFQFDFIGDTLTDDEINIAESFKEFAELLNEVENERMMMVHNASDLLIKPLENFRKEQIGFTKERKKKFEKDGERFYSLLDRHLHLSSKKKESQLQEADLQVDKERHNFFESSLDYVYQIQEVQESKKFNIVEPVLAFLHSLFISNSLTVELTQDFLPYKQQLQLSLQNTRNHFSSTREEMEELKKRMKEAPQTCKLPGQPTIEGYLYTQEKWALGISWVKYYCQYEKETKTLTMTPMEQKPGAKQGPLDLTLKYCVRRKTESIDKRFCFDIETNERPGTITLQALSEANRRLWMEAMDGKEPIYHSPITKQQEMELNEVGFKFVRKCINIIETKGIKTEGLYRTVGSNIQVQKLLNAFFDPKCPGDVDFHNSDWDIKTITSSLKFYLRNLSEPVMTYRLHKELVSAAKSDNLDYRLGAIHSLVYKLPEKNREMLELLIRHLVNVCEHSKENLMTPSNMGVIFGPTLMRAQEDTVAAMMNIKFQNIVVEILIEHFGKIYLGPPEESAAPPVPPPRVTARRHKPITISKRLLRERTVFYTSSLDESEDEIQHQTPNGTITSSIEPPKPPQHPKLPIQRSGETDPGRKSPSRPILDGKLEPCPEVDVGKLVSRLQDGGTKITPKATNGPMPGSGPTKTPSFHIKRPAPRPLAHHKEGDADSFSKVRPPGEKPTIIRPPVRPPDPPCRAATPQKPEPKPDIVAGNAGEITSSVVASRTRFFETASRKTGSSQGRLPGDES

SEQ ID NO: 60094 - protein, 149 aa, Homo sapiens
  Payload ID: 12016
  Gene Symbol: OSTC
  Gene Name: oligosaccharyltransferase complex subunit (non-catalytic)
  Uniprot ID: Q9NRP0
  ENSP ID: ENSP00000354676
METLYRVPFLVLECPNLKLKKPPWLHMPSAMTVYALVVVSYFLITGGIIYDVIVEPPSVGSMTDEHGHQRPVAFLAYRVNGQYIMEGLASSFLFTMGGLGFIILDRSNAPNIPKLNRFLLLFIGFVCVLLSFFMARVFMRMKLPGYLMG

SEQ ID NO: 60095 - protein, 171 aa, Homo sapiens
  Payload ID: 12016
  Gene Symbol: OSTC
  Gene Name: oligosaccharyltransferase complex subunit (non-catalytic)
  Uniprot ID: Q9NRP0
  ENSP ID: ENSP00000426167
METLYRVPFLVLECPNLKLKKPPWLHMPSAMTVYALVVVSYFLITGGIIYDVIVEPPSVGSMTDEHGHQRPVAFLAYRVNGQYIMEGLASSFLFTMGGLGFIILDRSNAPNIPKLNRFLLLFIGFVCVLLSFFMARVFMRMKLPRSLALLPRLECSGVISAHYKLCLPGAI

SEQ ID NO: 60096 - protein, 83 aa, Homo sapiens
  Payload ID: 12016
  Gene Symbol: OSTC
  Gene Name: oligosaccharyltransferase complex subunit (non-catalytic)
  ENSP ID: ENSP00000478564
METLYRVPFLVLECPNLKLKKPPWLHMPSAMTVYALVVVSYFLITGGIIYDVIVEPPSVGSMTDEHGHQRPVAFLAYRGYLMG

SEQ ID NO: 60097 - protein, 37 aa, Homo sapiens
  Payload ID: 12017
  Gene Symbol: OST4
  Gene Name: oligosaccharyltransferase complex subunit 4 (non-catalytic)
  Uniprot ID: P0C6T2
  ENSP ID: ENSP00000454411
MITDVQLAIFANMLGVSLFLLVVLYHYVAVNNPKKQE

SEQ ID NO: 60098 - protein, 37 aa, Homo sapiens; identical to SEQ ID NO: 60097
  Payload ID: 12017
  Gene Symbol: OST4
  Gene Name: oligosaccharyltransferase complex subunit 4 (non-catalytic)
  Uniprot ID: P0C6T2
  ENSP ID: ENSP00000455716

SEQ ID NO: 60099 - protein, 37 aa, Homo sapiens; identical to SEQ ID NO: 60097
  Payload ID: 12017
  Gene Symbol: OST4
  Gene Name: oligosaccharyltransferase complex subunit 4 (non-catalytic)
  Uniprot ID: P0C6T2
  ENSP ID: ENSP00000457935

SEQ ID NO: 60100 - protein, 1036 aa, Homo sapiens
  Payload ID: 12018
  Gene Symbol: OGT
  Gene Name: O-linked N-acetylglucosamine (GlcNAc) transferase
  Uniprot ID: O15294
  ENSP ID: ENSP00000362805
MASSVGNVADSTGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 60101 - protein, 1046 aa, Homo sapiens
  Payload ID: 12018
  Gene Symbol: OGT
  Gene Name: O-linked N-acetylglucosamine (GlcNAc) transferase
  Uniprot ID: O15294
  ENSP ID: ENSP00000362824
MASSVGNVADSTEPTKRMLSFQGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 60102 - protein, 156 aa, Homo sapiens
  Payload ID: 12018
  Gene Symbol: OGT
  Gene Name: O-linked N-acetylglucosamine (GlcNAc) transferase
  ENSP ID: ENSP00000399729
MLSFQGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRL

SEQ ID NO: 60103 - protein, 524 aa, Homo sapiens
  Payload ID: 12019
  Gene Symbol: OMA1
  Gene Name: OMA1 zinc metallopeptidase
  Uniprot ID: Q96E52
  ENSP ID: ENSP00000360270
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLGHEIAHAVLGHAAEKAGMVHLLDFLGMIFLTMIWAICPRDSLALLCQWIQSKLQEYMFNRPYSRKLEAEADKIGLLLAAKACADIRASSVFWQQMEFVDSLHGQPKMPEWLSTHPSHGNRVEYLDRLIPQALKIREMCNCPPLSNPDPRLLFKLSTKHFLEESEKEDLNITKKQKMDTLPIQKQEQIPLTYIVEKRTGS

SEQ ID NO: 60104 - protein, 328 aa, Homo sapiens
  Payload ID: 12019
  Gene Symbol: OMA1
  Gene Name: OMA1 zinc metallopeptidase
  ENSP ID: ENSP00000391941
  MOD_RES (1)..(1): Any amino acid
XLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLGHEIAHAVLGHAAEKAGMVHLLDFLGMIFLTMIWAICPRDSLALLCQWIQSKLQEYMFNRPYSRKLEAEADKIGLLLAAKACADIRASSVFWQQMEFVDSLHGQPKMPEWLSTHPSHGNRVEYLDRLIPQLVREEKFIEQPEQIAELTLNSFIQNTEICRS

SEQ ID NO: 60105 - protein, 183 aa, Homo sapiens
  Payload ID: 12019
  Gene Symbol: OMA1
  Gene Name: OMA1 zinc metallopeptidase
  ENSP ID: ENSP00000392978
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEV

SEQ ID NO: 60106 - protein, 325 aa, Homo sapiens
  Payload ID: 12019
  Gene Symbol: OMA1
  Gene Name: OMA1 zinc metallopeptidase
  ENSP ID: ENSP00000395053
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLL

SEQ ID NO: 60107 - protein, 255 aa, Homo sapiens
  Payload ID: 12019
  Gene Symbol: OMA1
  Gene Name: OMA1 zinc metallopeptidase
  ENSP ID: ENSP00000409589
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTE

SEQ ID NO: 60108 - protein, 252 aa, Homo sapiens
  Payload ID: 12019
  Gene Symbol: OMA1
  Gene Name: OMA1 zinc metallopeptidase
  ENSP ID: ENSP00000416495
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDM

SEQ ID NO: 60109 - protein, 87 aa, Homo sapiens
  Payload ID: 12019
  Gene Symbol: OMA1
  Gene Name: OMA1 zinc metallopeptidase
  ENSP ID: ENSP00000474081
MSFICGLQSAARNHVFFRFNSLSNWRKCNTLASTSRGCHQVQVNHIVNKYQGLGVNQCDRWSFLPGNFHFYSTFNNKRTGGLSSTKS

SEQ ID NO: 60110 - protein, 109 aa, Homo sapiens
  Payload ID: 12020
  Gene Symbol: OCM
  Gene Name: oncomodulin
  Uniprot ID: P0CE72
  ENSP ID: ENSP00000242104
MSITDVLSADDIAAALQECRDPDTFEPQKFFQTSGLSKMSANQVKDVFRFIDNDQSGYLDEEELKFFLQKFESGARELTESETKSLMAAADNDGDGKIGAEEFQEMVHS

SEQ ID NO: 60111 - protein, 109 aa, Homo sapiens; identical to SEQ ID NO: 60110
  Payload ID: 12020
  Gene Symbol: OCM
  Gene Name: oncomodulin
  Uniprot ID: P0CE72
  ENSP ID: ENSP00000401365

SEQ ID NO: 60112 - protein, 109 aa, Homo sapiens
  Payload ID: 12021
  Gene Symbol: OCM2
  Gene Name: oncomodulin 2
  Uniprot ID: P0CE71
  ENSP ID: ENSP00000257627
MSITDVLSADDIAAALQECQDPDTFEPQKFFQTSGLSKMSASQVKDVFRFIDNDQSGYLDEEELKFFLQKFESGARELTESETKSLMAAADNDGDGKIGAEEFQEMVHS

SEQ ID NO: 60113 - protein, 545 aa, Homo sapiens
  Payload ID: 12022
  Gene Symbol: OIT3
  Gene Name: oncoprotein induced transcript 3
  Uniprot ID: Q8WWZ8
  ENSP ID: ENSP00000333900
MPPFLLLTCLFITGTSVSPVALDPCSAYISLNEPWRNTDHQLDESQGPPLCDNHVNGEWYHFTGMAGDAMPTFCIPENHCGTHAPVWLNGSHPLEGDGIVQRQACASFNGNCCLWNTTVEVKACPGGYYVYRLTKPSVCFHVYCGHFYDICDEDCHGSCSDTSECTCAPGTVLGPDRQTCFDENECEQNNGGCSEICVNLKNSYRCECGVGRVLRSDGKTCEDVEGCHNNNGGCSHSCLGSEKGYQCECPRGLVLSEDNHTCQVPVLCKSNAIEVNIPRELVGGLELFLTNTSCRGVSNGTHVNILFSLKTCGTVVDVVNDKIVASNLVTGLPKQTPGSSGDFIIRTSKLLIPVTCEFPRLYTISEGYVPNLRNSPLEIMSRNHGIFPFTLEIFKDNEFEEPYREALPTLKLRDSLYFGIEPVVHVSGLESLVESCFATPTSKIDEVLKYYLIRDGCVSDDSVKQYTSRDHLAKHFQVPVFKFVGKDHKEVFLHCRVLVCGVLDERSRCAQGCHRRMRRGAGGEDSAGLQGQTLTGGPIRIDWED

SEQ ID NO: 60114 - protein, 321 aa, Homo sapiens
  Payload ID: 12022
  Gene Symbol: OIT3
  Gene Name: oncoprotein induced transcript 3
  Uniprot ID: Q8WWZ8
  ENSP ID: ENSP00000479787
MPPFLLLTCLFITGTSVSPVALDPCSAYISLNEPWRNTDHQLDESQGPPLCDNHVNGEWYHFTGMAGDAMPTFCIPENHCGTHAPVWLNGSHPLEGDGIVQRQACASFNGNCCLWNTTVEVKACPGGYYVYRLTKPSVCFHVYCGHFYDICDEDCHGSCSDTSECTCAPGTVLGPDRQTCFDENECEQNNGGCSEICVNLKNSYRCECGVGRVLRSDGKTCEDVEGCHNNNGGCSHSCLGSEKGYQCECPRGLVLSEDNHTCQVPVLCKSNAIEVNIPRELVGGLELFLTNTSCRGVSNGTHVNILFSLKTCGTVVDLCFR

SEQ ID NO: 60115 - protein, 252 aa, Homo sapiens
  Payload ID: 12023
  Gene Symbol: OSM
  Gene Name: oncostatin M
  Uniprot ID: P13725
  ENSP ID: ENSP00000215781
MGVLLTQRTLLSLVLALLFPSMASMAAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 60116 - protein, 231 aa, Homo sapiens
  Payload ID: 12023
  Gene Symbol: OSM
  Gene Name: oncostatin M
  ENSP ID: ENSP00000383893
MASMAAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 60117 - protein, 20 aa, Homo sapiens
  Payload ID: 12023
  Gene Symbol: OSM
  Gene Name: oncostatin M
  ENSP ID: ENSP00000384543
MGVLLTQRTLLNTYPRPGCS

SEQ ID NO: 60118 - protein, 979 aa, Homo sapiens
  Payload ID: 12024
  Gene Symbol: OSMR
  Gene Name: oncostatin M receptor
  Uniprot ID: Q99650
  ENSP ID: ENSP00000274276
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRVYLMNPFSVNFENVNATNAIMTWKVHSIRNNFTYLCQIELHGEGKMMQYNVSIKVNGEYFLSELEPATEYMARVRCADASHFWKWSEWSGQNFTTLEAAPSEAPDVWRIVSLEPGNHTVTLFWKPLSKLHANGKILFYNVVVENLDKPSSSELHSIPAPANSTKLILDRCSYQICVIANNSVGASPASVIVISADPENKEVEEERIAGTEGGFSLSWKPQPGDVIGYVVDWCDHTQDVLGDFQWKNVGPNTTSTVISTDAFRPGVRYDFRIYGLSTKRIACLLEKKTGYSQELAPSDNPHVLVDTLTSHSFTLSWKDYSTESQPGFIQGYHVYLKSKARQCHPRFEKAVLSDGSECCKYKIDNPEEKALIVDNLKPESFYEFFITPFTSAGEGPSATFTKVTTPDEHSSMLIHILLPMVFCVLLIMVMCYLKSQWIKETCYPDIPDPYKSSILSLIKFKENPHLIIMNVSDCIPDAIEVVSKPEGTKIQFLGTRKSLTETELTKPNYLYLLPTEKNHSGPGPCICFENLTYNQAASDSGSCGHVPVSPKAPSMLGLMTSPENVLKALEKNYMNSLGEIPAGETSLNYVSQLASPMFGDKDSLPTNPVEAPHCSEYKMQMAVSLRLALPPPTENSSLSSITLLDPGEHYC

SEQ ID NO: 60119 - protein, 342 aa, Homo sapiens
  Payload ID: 12024
  Gene Symbol: OSMR
  Gene Name: oncostatin M receptor
  Uniprot ID: Q99650
  ENSP ID: ENSP00000422023
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRGETRVVTAHRGH

SEQ ID NO: 60120 - protein, 35 aa, Homo sapiens
  Payload ID: 12024
  Gene Symbol: OSMR
  Gene Name: oncostatin M receptor
  ENSP ID: ENSP00000422372
  MOD_RES (1)..(1): Any amino acid
XIKETCYPDIPDPYKSSILSLIKFKISSKVWLNRR

SEQ ID NO: 60121 - protein, 188 aa, Homo sapiens
  Payload ID: 12024
  Gene Symbol: OSMR
  Gene Name: oncostatin M receptor
  ENSP ID: ENSP00000423913
LEPATEYMARVRCADASHFWKWSEWSGQNFTTLEAAPSEAPDVWRIVSLEPGNHTVTLFWKPLSKLHANGKILFYNVVVENLDKPSSSELHSIPAPANSTKLILDRCSYQICVIANNSVGASPASVIVISADPENSVSTCFSGTVPSVWGEGDFSHGSGHFCPGDSSTYMGNYLKFIQVTATLTNSHH

SEQ ID NO: 60122 - protein, 62 aa, Homo sapiens
  Payload ID: 12024
  Gene Symbol: OSMR
  Gene Name: oncostatin M receptor
  ENSP ID: ENSP00000426729
  MOD_RES (1)..(1): Any amino acid
XSMLIHILLPMVFCVLLIMVMCYLKSQWIKETCYPDIPDPYKSSILSLIKFKISSKVWLNRR

SEQ ID NO: 60123 - protein, 465 aa, Homo sapiens
  Payload ID: 12025
  Gene Symbol: ONECUT1
  Gene Name: one cut homeobox 1
  Uniprot ID: Q9UBC0
  ENSP ID: ENSP00000302630
MNAQLTMEAIGELHGVSHEPVPAPADLLGGSPHARSSVAHRGSHLPPAHPRSMGMASLLDGGSGGGDYHHHHRAPEHSLAGPLHPTMTMACETPPGMSMPTTYTTLTPLQPLPPISTVSDKFPHHHHHHHHHHHPHHHQRLAGNVSGSFTLMRDERGLASMNNLYTPYHKDVAGMGQSLSPLSSSGLGSIHNSQQGLPHYAHPGAAMPTDKMLTPNGFEAHHPAMLGRHGEQHLTPTSAGMVPINGLPPHHPHAHLNAQGHGQLLGTAREPNPSVTGAQVSNGSNSGQMEEINTKEVAQRITTELKRYSIPQAIFAQRVLCRSQGTLSDLLRNPKPWSKLKSGRETFRRMWKWLQEPEFQRMSALRLAACKRKEQEHGKDRGNTPKKPRLVFTDVQRRTLHAIFKENKRPSKELQITISQQLGLELSTVSNFFMNARRRSLDKWQDEGSSNSGNSSSSSSTCTKA

SEQ ID NO: 60124 - protein, 66 aa, Homo sapiens
  Payload ID: 12025
  Gene Symbol: ONECUT1
  Gene Name: one cut homeobox 1
  ENSP ID: ENSP00000453718
MESQKSFIKHAKGKNKNMGRIEATHPKSPGWSSQMSSVELYMQYSRKISVHPKNCKSPFPSSWGWS

SEQ ID NO: 60125 - protein, 182 aa, Homo sapiens
  Payload ID: 12025
  Gene Symbol: ONECUT1
  Gene Name: one cut homeobox 1
  ENSP ID: ENSP00000476168
  MOD_RES (1)..(1): Any amino acid
XLYTPYHKDVAGMGQSLSPLSSSGLGSIHNSQQGLPHYAHPGAAMPTDKMLTPNGFEAHHPAMLGRHGEQHLTPTSAGMVPINGLPPHHPHAHLNAQGHGQLLGTAREPNPSVTGAQAIFAQRVLCRSQGTLSDLLRNPKPWSKLKSGRETFRRMWKWLQEPEFQRMSALRLAGTAREARTA

SEQ ID NO: 60126 - protein, 504 aa, Homo sapiens
  Payload ID: 12026
  Gene Symbol: ONECUT2
  Gene Name: one cut homeobox 2
  Uniprot ID: O95948
  ENSP ID: ENSP00000419185
MKAAYTAYRCLTKDLEGCAMNPELTMESLGTLHGPAGGGSGGGGGGGGGGGGGGPGHEQELLASPSPHHAGRGAAGSLRGPPPPPTAHQELGTAAAAAAAASRSAMVTSMASILDGGDYRPELSIPLHHAMSMSCDSSPPGMGMSNTYTTLTPLQPLPPISTVSDKFHHPHPHHHPHHHHHHHHQRLSGNVSGSFTLMRDERGLPAMNNLYSPYKEMPGMSQSLSPLAATPLGNGLGGLHNAQQSLPNYGPPGHDKMLSPNFDAHHTAMLTRGEQHLSRGLGTPPAAMMSHLNGLHHPGHTQSHGPVLAPSRERPPSSSSGSQVATSGQLEEINTKEVAQRITAELKRYSIPQAIFAQRVLCRSQGTLSDLLRNPKPWSKLKSGRETFRRMWKWLQEPEFQRMSALRLAACKRKEQEPNKDRNNSQKKSRLVFTDLQRRTLFAIFKENKRPSKEMQITISQQLGLELTTVSNFFMNARRRSLEKWQDDLSTGGSSSTSSTCTKA

SEQ ID NO: 60127 - protein, 494 aa, Homo sapiens
  Payload ID: 12027
  Gene Symbol: ONECUT3
  Gene Name: one cut homeobox 3
  Uniprot ID: O60422
  ENSP ID: ENSP00000371786
MELSLESLGGLHSVAHAQAGELLSPGHARSAAAQHRGLVAPGRPGLVAGMASLLDGGGGGGGGGAGGAGGAGSAGGGADFRGELAGPLHPAMGMACEAPGLGGTYTTLTPLQHLPPLAAVADKFHQHAAAAAVAGAHGGHPHAHPHPAAAPPPPPPPQRLAASVSGSFTLMRDERAALASVGHLYGPYGKELPAMGSPLSPLPNALPPALHGAPQPPPPPPPPPLAAYGPPGHLAGDKLLPPAAFEPHAALLGRAEDALARGLPGGGGGTGSGGAGSGSAAGLLAPLGGLAAAGAHGPHGGGGGPGGSGGGPSAGAAAEEINTKEVAQRITAELKRYSIPQAIFAQRILCRSQGTLSDLLRNPKPWSKLKSGRETFRRMWKWLQEPEFQRMSALRLAACKRKEQEQQKERALQPKKQRLVFTDLQRRTLIAIFKENKRPSKEMQVTISQQLGLELNTVSNFFMNARRRCMNRWAEEPSTAPGGPAGATATFSKA

SEQ ID NO: 60128 - protein, 149 aa, Homo sapiens
  Payload ID: 12028
  Gene Symbol: OOEP
  Gene Name: oocyte expressed protein
  Uniprot ID: A6NGQ2
  ENSP ID: ENSP00000359384
MVDDAGAAESQRGKQTPAHSLEQLRRLPLPPPQIRIRPWWFPVQELRDPLVFYLEAWLADELFGPDRAIIPEMEWTSQALLTVDIVDSGNLVEITVFGRPRVQNRVKSMLLCLAWFHREHRARAEKMKHLEKNLKAHASDPHSPQDPVA

SEQ ID NO: 60129 - protein, 94 aa, Homo sapiens
  Payload ID: 12028
  Gene Symbol: OOEP
  Gene Name: oocyte expressed protein
  ENSP ID: ENSP00000359388
MFSTVTHKGPDRAIIPEMEWTSQALLTVDIVDSGNLVEITVFGRPRVQNRVKSMLLCLAWFHREHRARAEKMKHLEKNLKAHASDPHSPQDPVA

SEQ ID NO: 60130 - protein, 67 aa, Homo sapiens
  Payload ID: 12028
  Gene Symbol: OOEP
  Gene Name: oocyte expressed protein
  ENSP ID: ENSP00000397430
MFSTVTHKGPDRAIIPEMEWTSQALLTVDIVDSGNLVEITVFGRPRVQNRVKSMLLCLAWFHREHRA

SEQ ID NO: 60131 - protein, 158 aa, Homo sapiens
  Payload ID: 12029
  Gene Symbol: OOSP2
  Gene Name: oocyte secreted protein 2
  Uniprot ID: Q86WS3
  ENSP ID: ENSP00000278855
MALEVLMLLAVLIWTGAENLHVKISCSLDWLMVSVIPVAESRNLYIFADELHLGMGCPANRIHTYVYEFIYLVRDCGIRTRVVSEETLLFQTELYFTPRNIDHDPQEIHLECSTSRKSVWLTPVSTENEIKLDPSPFIADFQTTAEELGLLSSSPNLL

SEQ ID NO: 60132 - protein, 86 aa, Homo sapiens
  Payload ID: 12029
  Gene Symbol: OOSP2
  Gene Name: oocyte secreted protein 2
  ENSP ID: ENSP00000433831
MVSVIPVAESRNLYIFADELHLGMGCPANRIHTYVYEFIYLVRDCGIRTRVVSEETLLFQTELYFTPRNIDHDPQEIHLECSTSSV

SEQ ID NO: 60133 - protein, 229 aa, Homo sapiens
  Payload ID: 12030
  Gene Symbol: OIP5
  Gene Name: Opa interacting protein 5
  Uniprot ID: O43482
  ENSP ID: ENSP00000220514
MAAQPLRHRSRCATPPRGDFCGGTERAIDQASFTTSMEWDTQVVKGSSPLGPAGLGAEEPAAGPQLPSWLQPERCAVFQCAQCHAVLADSVHLAWDLSRSLGAVVFSRVTNNVVLEAPFLVGIEGSLKGSTYNLLFCGSCGIPVGFHLYSTHAALAALRGHFCLSSDKMVCYLLKTKAIVNASEMDIQNVPLSEKIAELKEKIVLTHNRLKSLMKILSEVTPDQSKPEN

SEQ ID NO: 60134 - protein, 162 aa, Homo sapiens
  Payload ID: 12030
  Gene Symbol: OIP5
  Gene Name: Opa interacting protein 5
  ENSP ID: ENSP00000452851
  MOD_RES (1)..(1): Any amino acid
XRAIDQASFTTSMEWDTQVVKGSSPLGPAGLGAEEPAAGPQLPSWLQPERCAVFQCAQCHAVLADSVHLAWDLSRSLGAVVFSRVTNNVVLEAPFLVGIEGSLKGSYLLKTKAIVNASEMDIQNVPLSEKIAELKEKIVLTHNRLKSLMKILSEVTPDQSKP

SEQ ID NO: 60135 - protein, 370 aa, Homo sapiens
  Payload ID: 12031
  Gene Symbol: OPRL1
  Gene Name: opiate receptor-like 1
  Uniprot ID: P41146
  ENSP ID: ENSP00000336764
MEPLFPAPFWEVIYGSHLQGNLSLLSPNHSLLPPHLLLNASHGAFLPLGLKVTIVGLYLAVCVGGLLGNCLVMYVILRHTKMKTATNIYIFNLALADTLVLLTLPFQGTDILLGFWPFGNALCKTVIAIDYYNMFTSTFTLTAMSVDRYVAICHPIRALDVRTSSKAQAVNVAIWALASVVGVPVAIMGSAQVEDEEIECLVEIPTPQDYWGPVFAICIFLFSFIVPVLVISVCYSLMIRRLRGVRLLSGSREKDRNLRRITRLVLVVVAVFVGCWTPVQVFVLAQGLGVQPSSETAVAILRFCTALGYVNSCLNPILYAFLDENFKACFRKFCCASALRRDVQVSDRVRSIAKDVALACKTSETVPRPA

SEQ ID NO: 60136 - protein, 370 aa, Homo sapiens; identical to SEQ ID NO: 60135
  Payload ID: 12031
  Gene Symbol: OPRL1
  Gene Name: opiate receptor-like 1
  Uniprot ID: P41146
  ENSP ID: ENSP00000336843

SEQ ID NO: 60137 - protein, 370 aa, Homo sapiens; identical to SEQ ID NO: 60135
  Payload ID: 12031
  Gene Symbol: OPRL1
  Gene Name: opiate receptor-like 1
  Uniprot ID: P41146
  ENSP ID: ENSP00000347848

SEQ ID NO: 60138 - protein, 293 aa, Homo sapiens
  Payload ID: 12031
  Gene Symbol: OPRL1
  Gene Name: opiate receptor-like 1
  ENSP ID: ENSP00000478920
  MOD_RES (1)..(1): Any amino acid
XHTKMKTATNIYIFNLALADTLVLLTLPFQGTDILLGFWPFGNALCKTVIAIDYYNMFTSTFTLTAMSVDRYVAICHPIRALDVRTSSKAQAVNVAIWALASVVGVPVAIMGSAQVEDEEIECLVEIPTPQDYWGPVFAICIFLFSFIVPVLVISVCYSLMIRRLRGVRLLSGSREKDRNLRRITRLVLVVVAVFVGCWTPVQVFVLAQGLGVQPSSETAVAILRFCTALGYVNSCLNPILYAFLDENFKACFRKFCCASALRRDVQVSDRVRSIAKDVALACKTSETVPRPA

SEQ ID NO: 60139 - protein, 293 aa, Homo sapiens; identical to SEQ ID NO: 60138
  Payload ID: 12031
  Gene Symbol: OPRL1
  Gene Name: opiate receptor-like 1
  ENSP ID: ENSP00000485794
  MOD_RES (1)..(1): Any amino acid

SEQ ID NO: 60140 - protein, 293 aa, Homo sapiens; identical to SEQ ID NO: 60138
  Payload ID: 12031
  Gene Symbol: OPRL1
  Gene Name: opiate receptor-like 1
  ENSP ID: ENSP00000487083
  MOD_RES (1)..(1): Any amino acid

SEQ ID NO: 60141 - protein, 345 aa, Homo sapiens
  Payload ID: 12032
  Gene Symbol: OPCML
  Gene Name: opioid binding protein/cell adhesion molecule-like
  Uniprot ID: Q14982
  ENSP ID: ENSP00000330862
MGVCGYLFLPWKCLVVVSLRLLFLVPTGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 60142 - protein, 304 aa, Homo sapiens
  Payload ID: 12032
  Gene Symbol: OPCML
  Gene Name: opioid binding protein/cell adhesion molecule-like
  Uniprot ID: Q14982
  ENSP ID: ENSP00000363910
MDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 60143 - protein, 338 aa, Homo sapiens
  Payload ID: 12032
  Gene Symbol: OPCML
  Gene Name: opioid binding protein/cell adhesion molecule-like
  Uniprot ID: Q14982
  ENSP ID: ENSP00000434750
MYHPAYWVVFSATTALLFIPGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 60144 - protein, 354 aa, Homo sapiens
  Payload ID: 12032
  Gene Symbol: OPCML
  Gene Name: opioid binding protein/cell adhesion molecule-like
  Uniprot ID: Q14982
  ENSP ID: ENSP00000445496
MGVCGYLFLPWKCLVVVSLRLLFLVPTGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYEISPSSAVAGPGAVIDGVNSASRALACLWLSGTLLAHFFIKF

SEQ ID NO: 60145 - protein, 345 aa, Homo sapiens; identical to SEQ ID NO: 60141
  Payload ID: 12032
  Gene Symbol: OPCML
  Gene Name: opioid binding protein/cell adhesion molecule-like
  Uniprot ID: Q14982
  ENSP ID: ENSP00000482061

SEQ ID NO: 60146 - protein, 677 aa, Homo sapiens
  Payload ID: 12033
  Gene Symbol: OGFR
  Gene Name: opioid growth factor receptor
  Uniprot ID: Q9NZT2
  ENSP ID: ENSP00000290291
MDDPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQGRTCGPEHSKGGGRVDEGPQPRSVEPQDAGPLERSQGDEAGGHGEDRPEPLSPKESKKRKLELSRREQPPTEPGPQSASEVEKIALNLEGCALSQGSLRTGTQEVGGQDPGEAVQPCRQPLGARVADKVRKRRKVDEGAGDSAAVASGGAQTLALAGSPAPSGHPKAGHSENGVEEDTEGRTGPKEGTPGSPSETPGPSPAGPAGDEPAESPSETPGPRPAGPAGDEPAESPSETPGPRPAGPAGDEPAESPSETPGPSPAGPTRDEPAESPSETPGPRPAGPAGDEPAESPSETPGPRPAGPAGDEPAESPSETPGPSPAGPTRDEPAKAGEAAELQDAEVESSAKSGKP

SEQ ID NO: 60147 - protein, 625 aa, Homo sapiens
  Payload ID: 12033
  Gene Symbol: OGFR
  Gene Name: opioid growth factor receptor
  ENSP ID: ENSP00000359491
MRLPERHGGPQGSLCLMDPCCPLSLALQDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQGRTCGPEHSKGGGRVDEGPQPRSVEPQDAGPLERSQGDEAGGHGEDRPEPLSPKESKKRKLELSRREQPPTEPGPQSASEVEKIALNLEGCALSQGSLRTGTQEVGGQDPGEAVQPCRQPLGARVADKVRKRRKVDEGAGDSAAVASGGAQTLALAGSPAPSGHPKAGHSENGVEEDTEGRTGPKEGTPGSPSETPGPSPAGPAGDEPAESPSETPGPRPAGPAGDEPAESPSETPGPRPAGPAGDEPAESPSETPGPSPAGPTRDEPAESPSETPGPRPAGPAGDEPAESPSETPGPRPAGPAGDEPAESPSETPGPSPAGPTRDEPAKAGEAAELQDAEVESSAKSGKP

SEQ ID NO: 60148 - protein, 94 aa, Homo sapiens
  Payload ID: 12033
  Gene Symbol: OGFR
  Gene Name: opioid growth factor receptor
  ENSP ID: ENSP00000395168
MTGSRNWRATRDMCRYRHNYPDLVERDCNGDTPNLSFYRNEIRFLPNGCFIEDILQNWTDNYDLLEDNHSYIQWLFPLREPGVNWHAKPLTLRE

SEQ ID NO: 60149 - protein, 390 aa, Homo sapiens
  Payload ID: 12033
  Gene Symbol: OGFR
  Gene Name: opioid growth factor receptor
  ENSP ID: ENSP00000483055
MDDPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGPAGDEPAESPSETPGPSPAGPTRDEPAKAGEAEASGLAVSSHPALPCAPVFVNPFWSGGRRAGLLLSLIPSKAFSE

SEQ ID NO: 60150 - protein, 451 aa, Homo sapiens
  Payload ID: 12034
  Gene Symbol: OGFRL1
  Gene Name: opioid growth factor receptor-like 1
  Uniprot ID: Q5TC84
  ENSP ID: ENSP00000359464
MGNLLGGVSFREPTTVEDCDSTWQTDSEPEPEEPGPGGGSEGPGQESEQPAQPPEQAGGRPGASPAPDEDAEAAGAEQGGDSTEATAKPKRSFYAARDLYKYRHQYPNFKDIRYQNDLSNLRFYKNKIPFKPDGVYIEEVLSKWKGDYEKLEHNHTYIQWLFPLREQGLNFYAKELTTYEIEEFKKTKEAIRRFLLAYKMMLEFFGIKLTDKTGNVARAVNWQERFQHLNESQHNYLRITRILKSLGELGYESFKSPLVKFILHEALVENTIPNIKQSALEYFVYTIRDRRERRKLLRFAQKHYTPSENFIWGPPRKEQSEGSKAQKMSSPLASSHNSQTSMHKKAKDSKNSSSAVHLNSKTAEDKKVAPKEPVEETDRPSPEPSNEAAKPRNTEKDSNAENMNSQPEKTVTTPTEKKESVSPENNEEGGNDNQDNENPGNTNCHDVVLVQ

SEQ ID NO: 60151 - protein, 372 aa, Homo sapiens
  Payload ID: 12035
  Gene Symbol: OPRD1
  Gene Name: opioid receptor, delta 1
  Uniprot ID: P41143
  ENSP ID: ENSP00000234961
MEPAPSAGAELQPPLFANASDAYPSACPSAGANASGPPGARSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVPILIITVCYGLMLLRLRSVRLLSGSKEKDRSLRRITRMVLVVVGAFVVCWAPIHIFVIVWTLVDIDRRDPLVVAALHLCIALGYANSSLNPVLYAFLDENFKRCFRQLCRKPCGRPDPSSFSRAREATARERVTACTPSDGPGGGAAA

SEQ ID NO: 60152 - protein, 324 aa, Homo sapiens
  Payload ID: 12035
  Gene Symbol: OPRD1
  Gene Name: opioid receptor, delta 1
  ENSP ID: ENSP00000477970
MEPAPSAGAELQPPLFANASDAYPSACPSAGANASGPPGARSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVCWAPIHIFVIVWTLVDIDRRDPLVVAALHLCIALGYANSSLNPVLYAFLDENFKRCFRQLCRKPCGRPDPSSFSRAREATARERVTACTPSDGPGGGAAA

SEQ ID NO: 60153 - protein, 380 aa, Homo sapiens
  Payload ID: 12036
  Gene Symbol: OPRK1
  Gene Name: opioid receptor, kappa 1
  Uniprot ID: P41145
  ENSP ID: ENSP00000265572
MDSPIQIFRGEPGPTCAPSACLPPNSSAWFPGWAEPDSNGSAGSEDAQLEPAHISPAIPVIITAVYSVVFVVGLVGNSLVMFVIIRYTKMKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRITRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 60154 - protein, 116 aa, Homo sapiens
  Payload ID: 12036
  Gene Symbol: OPRK1
  Gene Name: opioid receptor, kappa 1
  ENSP ID: ENSP00000428231
MDSPIQIFRGEPGPTCAPSACLPPNSSAWFPGWAEPDSNGSAGSEDAQLEPAHISPAIPVIITAVYSVVFVVGLVGNSLVMFVIIRLEFQWKTTKPCDELRDPKGTGVKPGREALD

SEQ ID NO: 60155 - protein, 380 aa, Homo sapiens; identical to SEQ ID NO: 60153
  Payload ID: 12036
  Gene Symbol: OPRK1
  Gene Name: opioid receptor, kappa 1
  Uniprot ID: P41145
  ENSP ID: ENSP00000429706

SEQ ID NO: 60156 - protein, 291 aa, Homo sapiens
  Payload ID: 12036
  Gene Symbol: OPRK1
  Gene Name: opioid receptor, kappa 1
  Uniprot ID: P41145
  ENSP ID: ENSP00000430923
MKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRITRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 60157 - protein, 366 aa, Homo sapiens
  Payload ID: 12036
  Gene Symbol: OPRK1
  Gene Name: opioid receptor, kappa 1
  ENSP ID: ENSP00000478453
MDSPIQIFRGEPGPTCAPSACLPPNSSAGSEDAQLEPAHISPAIPVIITAVYSVVFVVGLVGNSLVMFVIIRYTKMKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRITRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 60158 - protein, 291 aa, Homo sapiens; identical to SEQ ID NO: 60156
  Payload ID: 12036
  Gene Symbol: OPRK1
  Gene Name: opioid receptor, kappa 1
  Uniprot ID: P41145
  ENSP ID: ENSP00000483000

SEQ ID NO: 60159 - protein, 446 aa, Homo sapiens
  Payload ID: 12037
  Gene Symbol: OPRM1
  Gene Name: opioid receptor, mu 1
  Uniprot ID: P35372
  ENSP ID: ENSP00000229768
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQCLPIPSLSCWALEQGCLVVYPGPLQGPLVRYDLPAILHSSCLRGNTAPSPSGGAFLLS

SEQ ID NO: 60160 - protein, 400 aa, Homo sapiens
  Payload ID: 12037
  Gene Symbol: OPRM1
  Gene Name: opioid receptor, mu 1
  Uniprot ID: P35372
  ENSP ID: ENSP00000328264
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 60161 - protein, 418 aa, Homo sapiens
  Payload ID: 12037
  Gene Symbol: OPRM1
  Gene Name: opioid receptor, mu 1
  Uniprot ID: P35372
  ENSP ID: ENSP00000338381
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQPPLAVSMAQIFTRYPPPTHREKTCNDYMKR

SEQ ID NO: 60162 - protein, 476 aa, Homo sapiens
  Payload ID: 12037
  Gene Symbol: OPRM1
  Gene Name: opioid receptor, mu 1
  ENSP ID: ENSP00000353598
MSDAQLGPLRLTLLSVSARTGFCKKQQELWQRRKEAAEALGTRKVSVLLATSHSGARPAVSTMDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQNYYIIHRCCCNTPLISQKPVLLWFCD

SEQ ID NO: 60163 - protein, 493 aa, Homo sapiens
  Payload ID: 12037
  Gene Symbol: OPRM1
  Gene Name: opioid receptor, mu 1
  Uniprot ID: P35372
  ENSP ID: ENSP00000394624
MCLHRRVPSEETYSLDRFAQNPPLFPPPSLPASESRMAHAPLLQRCGAARTGFCKKQQELWQRRKEAAEALGTRKVSVLLATSHSGARPAVSTMDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 60164 - protein, 403 aa, Homo sapiens
  Payload ID: 12037
  Gene Symbol: OPRM1
  Gene Name: opioid receptor, mu 1
  Uniprot ID: P35372
  ENSP ID: ENSP00000399359
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQGPPAKFVADQLAGSS

SEQ ID NO: 60165 - protein, 420 aa, Homo sapiens
  Payload ID: 12037
  Gene Symbol: OPRM1
  Gene Name: opioid receptor, mu 1
  Uniprot ID: P35372
  ENSP ID: ENSP00000403549
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQVELNLDCHCENAKPWPLSYNAGQSPFPFPGRV

SEQ ID NO: 60166 - protein, 406 aa, Homo sapiens
  Payload ID: 12037
  Gene Symbol: OPRM1
  Gene Name: opioid receptor, mu 1
  Uniprot ID: P35372
  ENSP ID: ENSP00000410497
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQKIDLFQKSSLLNCEHTKG

SEQ ID NO: 60167 - protein, 392 aa, Homo sapiens
  Payload ID: 12037
  Gene Symbol: OPRM1
  Gene Name: opioid receptor, mu 1
  Uniprot ID: P35372
  ENSP ID: ENSP00000411903
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQVRSL

SEQ ID NO: 60168 - protein, 397 aa, Homo sapiens
  Payload ID: 12037
  Gene Symbol: OPRM1
  Gene Name: opioid receptor, mu 1
  Uniprot ID: P35372
  ENSP ID: ENSP00000413752
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQRERRQKSDW

SEQ ID NO: 60169 - protein, 402 aa, Homo sapiens
  Payload ID: 12037
  Gene Symbol: OPRM1
  Gene Name: opioid receptor, mu 1
  Uniprot ID: P35372
  ENSP ID: ENSP00000428018
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQIRDPISNLPRVSVF

SEQ ID NO: 60170 - protein, 300 aa, Homo sapiens
  Payload ID: 12037
  Gene Symbol: OPRM1
  Gene Name: opioid receptor, mu 1
  Uniprot ID: P35372
  ENSP ID: ENSP00000429373
MKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 60171 - protein, 300 aa, Homo sapiens; identical to SEQ ID NO: 60170
  Payload ID: 12037
  Gene Symbol: OPRM1
  Gene Name: opioid receptor, mu 1
  Uniprot ID: P35372
  ENSP ID: ENSP00000429719

SEQ ID NO: 60172 - protein, 389 aa, Homo sapiens
  Payload ID: 12037
  Gene Symbol: OPRM1
  Gene Name: opioid receptor, mu 1
  Uniprot ID: P35372
  ENSP ID: ENSP00000430097
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQS

SEQ ID NO: 60173 - protein, 162 aa, Homo sapiens
  Payload ID: 12037
  Gene Symbol: OPRM1
  Gene Name: opioid receptor, mu 1
  ENSP ID: ENSP00000430247
MVQARTGFCKKQQELWQRRKEAAEALGTRKVSVLLATSHSGARPAVSTMDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLAL

SEQ ID NO: 60174 - protein, 319 aa, Homo sapiens
  Payload ID: 12037
  Gene Symbol: OPRM1
  Gene Name: opioid receptor, mu 1
  Uniprot ID: P35372
  ENSP ID: ENSP00000430260
MMRAKSISTKAGKPSRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 60175 - protein, 186 aa, Homo sapiens
  Payload ID: 12037
  Gene Symbol: OPRM1
  Gene Name: opioid receptor, mu 1
  Uniprot ID: P35372
  ENSP ID: ENSP00000430575
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRFHRLYTNILSSNLVLGKPAEDLCFHLRLHYASAHHYRVLWTDDLAPQECPHALWLQRKGQESSKDHQDGAGGGGCVHRLLDSHSHLRHH

SEQ ID NO: 60176 - protein, 300 aa, Homo sapiens; identical to SEQ ID NO: 60170
  Payload ID: 12037
  Gene Symbol: OPRM1
  Gene Name: opioid receptor, mu 1
  Uniprot ID: P35372
  ENSP ID: ENSP00000430876

SEQ ID NO: 60177 - protein, 402 aa, Homo sapiens; identical to SEQ ID NO: 60169
  Payload ID: 12037
  Gene Symbol: OPRM1
  Gene Name: opioid receptor, mu 1
  Uniprot ID: P35372
  ENSP ID: ENSP00000431048

SEQ ID NO: 60178 - protein, 364 aa, Homo sapiens
  Payload ID: 12038
  Gene Symbol: OPN1LW
  Gene Name: opsin 1 (cone pigments), long-wave-sensitive
  Uniprot ID: P04000
  ENSP ID: ENSP00000358967
MAQQWSLQRLAGRHPQDSYEDSTQSSIFTYTNSNSTRGPFEGPNYHIAPRWVYHLTSVWMIFVVTASVFTNGLVLAATMKFKKLRHPLNWILVNLAVADLAETVIASTISIVNQVSGYFVLGHPMCVLEGYTVSLCGITGLWSLAIISWERWMVVCKPFGNVRFDAKLAIVGIAFSWIWAAVWTAPPIFGWSRYWPHGLKTSCGPDVFSGSSYPGVQSYMIVLMVTCCIIPLAIIMLCYLQVWLAIRAVAKQQKESESTQKAEKEVTRMVVVMIFAYCVCWGPYTFFACFAAANPGYAFHPLMAALPAYFAKSATIYNPVIYVFMNRQFRNCILQLFGKKVDDGSELSSASKTEVSSVSSVSPA

SEQ ID NO: 60179 - protein, 164 aa, Homo sapiens
  Payload ID: 12038
  Gene Symbol: OPN1LW
  Gene Name: opsin 1 (cone pigments), long-wave-sensitive
  ENSP ID: ENSP00000402493
ITGLWSLAIISWERWMVVCKPFGNVRFDAKLAIVGIAFSWIWAAVWTAPPIFGWSRYWPHGLKTSCGPDVFSGSSYPGVQSYMIVLMVTCCIIPLAIIMLCYLQVWLAIRAVAKQQKESESTQKAEKEFRNCILQLFGKKVDDGSELSSASKTEVSSVSSVSPA

SEQ ID NO: 60180 - protein, 164 aa, Homo sapiens
  Payload ID: 12039
  Gene Symbol: OPN1MW
  Gene Name: opsin 1 (cone pigments), medium-wave-sensitive
  ENSP ID: ENSP00000469055
  MOD_RES (1)..(1): Any amino acid
XTGLWSLAIISWERWMVVCKPFGNVRFDAKLAIVGIAFSWIWAAVWTAPPIFGWSRYWPHGLKTSCGPDVFSGSSYPGVQSYMIVLMVTCCITPLSIIVLCYLQVWLAIRAVAKQQKESESTQKAEKEFRNCILQLFGKKVDDGSELSSASKTEVSSVSSVSPA

SEQ ID NO: 60181 - protein, 364 aa, Homo sapiens
  Payload ID: 12039
  Gene Symbol: OPN1MW
  Gene Name: opsin 1 (cone pigments), medium-wave-sensitive
  Uniprot ID: P04001
  ENSP ID: ENSP00000472316
MAQQWSLQRLAGRHPQDSYEDSTQSSIFTYTNSNSTRGPFEGPNYHIAPRWVYHLTSVWMIFVVIASVFTNGLVLAATMKFKKLRHPLNWILVNLAVADLAETVIASTISVVNQVYGYFVLGHPMCVLEGYTVSLCGITGLWSLAIISWERWMVVCKPFGNVRFDAKLAIVGIAFSWIWAAVWTAPPIFGWSRYWPHGLKTSCGPDVFSGSSYPGVQSYMIVLMVTCCITPLSIIVLCYLQVWLAIRAVAKQQKESESTQKAEKEVTRMVVVMVLAFCFCWGPYAFFACFAAANPGYPFHPLMAALPAFFAKSATIYNPVIYVFMNRQFRNCILQLFGKKVDDGSELSSASKTEVSSVSSVSPA

SEQ ID NO: 60182 - protein, 364 aa, Homo sapiens; identical to SEQ ID NO: 60181
  Payload ID: 12040
  Gene Symbol: OPN1MW2
  Gene Name: opsin 1 (cone pigments), medium-wave-sensitive 2
  Uniprot ID: P04001
  ENSP ID: ENSP00000358945

SEQ ID NO: 60183 - protein, 164 aa, Homo sapiens; identical to SEQ ID NO: 60180
  Payload ID: 12040
  Gene Symbol: OPN1MW2
  Gene Name: opsin 1 (cone pigments), medium-wave-sensitive 2
  ENSP ID: ENSP00000403023
  MOD_RES (1)..(1): Any amino acid

SEQ ID NO: 60184 - protein, 364 aa, Homo sapiens; identical to SEQ ID NO: 60181
  Payload ID: 12041
  Gene Symbol: OPN1MW3
  Gene Name: opsin 1 (cone pigments), medium-wave-sensitive 3
  Uniprot ID: P04001
  ENSP ID: ENSP00000469970

SEQ ID NO: 60185 - protein, 348 aa, Homo sapiens
  Payload ID: 12042
  Gene Symbol: OPN1SW
  Gene Name: opsin 1 (cone pigments), short-wave-sensitive
  Uniprot ID: P03999
  ENSP ID: ENSP00000249389
MRKMSEEEFYLFKNISSVGPWDGPQYHIAPVWAFYLQAAFMGTVFLIGFPLNAMVLVATLRYKKLRQPLNYILVNVSFGGFLLCIFSVFPVFVASCNGYFVFGRHVCALEGFLGTVAGLVTGWSLAFLAFERYIVICKPFGNFRFSSKHALTVVLATWTIGIGVSIPPFFGWSRFIPEGLQCSCGPDWYTVGTKYRSESYTWFLFIFCFIVPLSLICFSYTQLLRALKAVAAQQQESATTQKAEREVSRMVVVMVGSFCVCYVPYAAFAMYMVNNRNHGLDLRLVTIPSFFSKSACIYNPIIYCFMNKQFQACIMKMVCGKAMTDESDTCSSQKTEVSTVSSTQVGPN

SEQ ID NO: 60186 - protein, 402 aa, Homo sapiens
  Payload ID: 12043
  Gene Symbol: OPN3
  Gene Name: opsin 3
  Uniprot ID: Q9H1Y3
  ENSP ID: ENSP00000355512
MYSGNRSGGHGYWDGGGAAGAEGPAPAGTLSPAPLFSPGTYERLALLLGSIGLLGVGNNLLVLVLYYKFQRLRTPTHLLLVNISLSDLLVSLFGVTFTFVSCLRNGWVWDTVGCVWDGFSGSLFGIVSIATLTVLAYERYIRVVHARVINFSWAWRAITYIWLYSLAWAGAPLLGWNRYILDVHGLGCTVDWKSKDANDSSFVLFLFLGCLVVPLGVIAHCYGHILYSIRMLRCVEDLQTIQVIKILKYEKKLAKMCFLMIFTFLVCWMPYIVICFLVVNGHGHLVTPTISIVSYLFAKSNTVYNPVIYVFMIRKFRRSLLQLLCLRLLRCQRPAKDLPAAGSEMQIRPIVMSQKDGDRPKKKVTFNSSSIIFIITSDESLSVDDSDKTNGSKVDVIQVRPL

SEQ ID NO: 60187 - protein, 478 aa, Homo sapiens
  Payload ID: 12044
  Gene Symbol: OPN4
  Gene Name: opsin 4
  Uniprot ID: Q9UHM6
  ENSP ID: ENSP00000241891
MNPPSGPRVPPSPTQEPSCMATPAPPSWWDSSQSSISSLGRLPSISPTAPGTWAAAWVPLPTVDVPDHAHYTLGTVILLVGLTGMLGNLTVIYTFCRSRSLRTPANMFIINLAVSDFLMSFTQAPVFFTSSLYKQWLFGETGCEFYAFCGALFGISSMITLTAIALDRYLVITRPLATFGVASKRRAAFVLLGVWLYALAWSLPPFFGWSAYVPEGLLTSCSWDYMSFTPAVRAYTMLLCCFVFFLPLLIIIYCYIFIFRAIRETGRALQTFGACKGNGESLWQRQRLQSECKMAKIMLLVILLFVLSWAPYSAVALVAFAGYAHVLTPYMSSVPAVIAKASAIHNPIIYAITHPKYRVAIAQHLPCLGVLLGVSRRHSRPYPSYRSTHRSTLTSHTSNLSWISIRRRQESLGSESEVGWTHMEAAAVWGAAQQANGRSLYGQGLEDLEAKAPPRPQGHEAETPGKTKGLIPSQDPRM

SEQ ID NO: 60188 - protein, 489 aa, Homo sapiens
  Payload ID: 12044
  Gene Symbol: OPN4
  Gene Name: opsin 4
  Uniprot ID: Q9UHM6
  ENSP ID: ENSP00000361141
MNPPSGPRVPPSPTQEPSCMATPAPPSWWDSSQSSISSLGRLPSISPTAPGTWAAAWVPLPTVDVPDHAHYTLGTVILLVGLTGMLGNLTVIYTFCRAVLRGVTVMMQSRSLRTPANMFIINLAVSDFLMSFTQAPVFFTSSLYKQWLFGETGCEFYAFCGALFGISSMITLTAIALDRYLVITRPLATFGVASKRRAAFVLLGVWLYALAWSLPPFFGWSAYVPEGLLTSCSWDYMSFTPAVRAYTMLLCCFVFFLPLLIIIYCYIFIFRAIRETGRALQTFGACKGNGESLWQRQRLQSECKMAKIMLLVILLFVLSWAPYSAVALVAFAGYAHVLTPYMSSVPAVIAKASAIHNPIIYAITHPKYRVAIAQHLPCLGVLLGVSRRHSRPYPSYRSTHRSTLTSHTSNLSWISIRRRQESLGSESEVGWTHMEAAAVWGAAQQANGRSLYGQGLEDLEAKAPPRPQGHEAETPGKTKGLIPSQDPRM

SEQ ID NO: 60189 - protein, 495 aa, Homo sapiens
  Payload ID: 12044
  Gene Symbol: OPN4
  Gene Name: opsin 4
  ENSP ID: ENSP00000393132
MNPPSGPRVPPSPTQEPSCMATPAPPSWWDSSQSSISSLGRLPSISPTAPGTWAAAWVPLPTVDVPDHAHYTLGTVILLVGLTGMLGNLTVIYTFCRAVLRGVTVMMQSRSLRTPANMFIINLAVSDFLMSFTQAPVFFTSSLYKQWLFGETGCEFYAFCGALFGISSMITLTAIALDRYLVITRPLATFGVASKRRAAFVLLGVWLYALAWSLPPFFGWSAYVPEGLLTSCSWDYMSFTPAVRAYTMLLCCFVFFLPLLIIIYCYIFIFRAIRETGRALQTFGACKGNGESLWQRQRLQSECKMAKIMLLVILLFVLSWAPYSAVALVAFAGYAHVLTPYMSSVPAVIAKASAIHNPIIYAITHPKYRVAIAQHLPCLGVLLGVSRRHSRPYPSYRSTHRSTLTSHTSNLSWISIRRRQESLGSESEVGWTHMEAAAVWGAAQQANGRSLYGQGLEDLEAKAPPRPQGHEAETPGKRRASSGRSQRPERQRAAP

SEQ ID NO: 60190 - protein, 354 aa, Homo sapiens
  Payload ID: 12045
  Gene Symbol: OPN5
  Gene Name: opsin 5
  Uniprot ID: Q6U736
  ENSP ID: ENSP00000360255
MALNHTALPQDERLPHYLRDGDPFASKLSWEADLVAGFYLTIIGILSTFGNGYVLYMSSRRKKKLRPAEIMTINLAVCDLGISVVGKPFTIISCFCHRWVFGWIGCRWYGWAGFFFGCGSLITMTAVSLDRYLKICYLSYGVWLKRKHAYICLAAIWAYASFWTTMPLVGLGDYVPEPFGTSCTLDWWLAQASVGGQVFILNILFFCLLLPTAVIVFSYVKIIAKVKSSSKEVAHFDSRIHSSHVLEMKLTKVAMLICAGFLIAWIPYAVVSVWSAFGRPDSIPIQLSVVPTLLAKSAAMYNPIIYQVIDYKFACCQTGGLKATKKKSLEGFRLHTVTTVRKSSAVLEIHEEWE

SEQ ID NO: 60191 - protein, 353 aa, Homo sapiens
  Payload ID: 12045
  Gene Symbol: OPN5
  Gene Name: opsin 5
  ENSP ID: ENSP00000377302
MALNHTALPQDERLPHYLRDGDPFASKLSWEADLVAGFYLTIIGILSTFGNGYVLYMSSRRKKKLRPAEIMTINLAVCDLGISVVGKPFTIISCFCHRWVFGWIGCRWYGWAGFFFGCGSLITMTAVSLDRYLKICYLSYGVWLKRKHAYICLAAIWAYASFWTTMPLVGLGDYVPEPFGTSCTLDWWLAQASVGGQVFILNILFFCLLLPTAVIVFSYVKIIAKVKSSSKEVAHFDSRIHSSHVLEMKLTKVAMLICAGFLIAWIPYAVVSVWSAFGRPDSIPIQLSVVPTLLAKSAAMYNPIIYQVIDYKFACCQTGGLKATKKKSLEGFRLHTVTTVRKSSAVLEIHEEV

SEQ ID NO: 60192 - protein, 382 aa, Homo sapiens
  Payload ID: 12045
  Gene Symbol: OPN5
  Gene Name: opsin 5
  ENSP ID: ENSP00000426991
MALNHTALPQDERLPHYLRDGDPFASKLSWEADLVAGFYLTIIGILSTFGNGYVLYMSSRRKKKLRPAEIMTINLAVCDLGISVVGKPFTIISCFCHRWVFGWIGCRWYGWAGFFFGCGSLITMTAVSLDRYLKICYLSYGVWLKRKHAYICLAAIWAYASFWTTMPLVGLGDYVPEPFGTSCTLDWWLAQASVGGQVFILNILFFCLLLPTAVIVFSYVKIIAKVKSSSKEVAHFDSRIHSSHVLEMKLTKVAMLICAGFLIAWIPYAVVSVWSAFGRPDSIPIQLSVVPTLLAKSAAMYNPIIYQVIDYKFACCQTGGLKATKKKSLEGFRLHTVTTVRKSSAVLEIHEEGRNKSASPNNLDADSHSNDDDCGKKYEPIF

SEQ ID NO: 60193 - protein, 978 aa, Homo sapiens
  Payload ID: 12046
  Gene Symbol: OPA1
  Gene Name: optic atrophy 1 (autosomal dominant)
  ENSP ID: ENSP00000354429
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGHKLVSEVIGASDLLLLLGSPEETAFRATDRGSESDKHFRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 60194 - protein, 997 aa, Homo sapiens
  Payload ID: 12046
  Gene Symbol: OPA1
  Gene Name: optic atrophy 1 (autosomal dominant)
  Uniprot ID: O60313
  ENSP ID: ENSP00000354681
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 60195 - protein, 961 aa, Homo sapiens
  Payload ID: 12046
  Gene Symbol: OPA1
  Gene Name: optic atrophy 1 (autosomal dominant)
  ENSP ID: ENSP00000354781
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 60196 - protein, 979 aa, Homo sapiens
  Payload ID: 12046
  Gene Symbol: OPA1
  Gene Name: optic atrophy 1 (autosomal dominant)
  ENSP ID: ENSP00000355311
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFGHKLVSEVIGASDLLLLLGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 60197 - protein, 1015 aa, Homo sapiens
  Payload ID: 12046
  Gene Symbol: OPA1
  Gene Name: optic atrophy 1 (autosomal dominant)
  ENSP ID: ENSP00000355324
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGHKLVSEVIGASDLLLLLGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 60198 - protein, 243 aa, Homo sapiens
  Payload ID: 12046
  Gene Symbol: OPA1
  Gene Name: optic atrophy 1 (autosomal dominant)
  ENSP ID: ENSP00000376231
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGHKLVSEVIGASDLLLLLGSPEETAFRATDRGSESDKHFRKGLLGELILLQQQIQEHE

SEQ ID NO: 60199 - protein, 166 aa, Homo sapiens
  Payload ID: 12046
  Gene Symbol: OPA1
  Gene Name: optic atrophy 1 (autosomal dominant)
  ENSP ID: ENSP00000376232
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFGSPEETAFRATDRGSES

SEQ ID NO: 60200 - protein, 960 aa, Homo sapiens
  Payload ID: 12046
  Gene Symbol: OPA1
  Gene Name: optic atrophy 1 (autosomal dominant)
  Uniprot ID: O60313
  ENSP ID: ENSP00000376233
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGSPEETAFRATDRGSESDKHFRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 60201 - protein, 183 aa, Homo sapiens
  Payload ID: 12046
  Gene Symbol: OPA1
  Gene Name: optic atrophy 1 (autosomal dominant)
  ENSP ID: ENSP00000398358
LASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKLQGTGLSTVAHACNPSTLGGQDGWKTRNVLFPQLGLNTTHQATTWRRTQH

SEQ ID NO: 60202 - protein, 84 aa, Homo sapiens
  Payload ID: 12046
  Gene Symbol: OPA1
  Gene Name: optic atrophy 1 (autosomal dominant)
  ENSP ID: ENSP00000399877
MIPDLSEYKWIVPDIVWEIDEYIDFEKIRKALPSSEDLVKLAPDFDKIVESLSLLKDFFTSGSPEETAFRATDRGSESDKHFRK

SEQ ID NO: 60203 - protein, 185 aa, Homo sapiens
  Payload ID: 12046
  Gene Symbol: OPA1
  Gene Name: optic atrophy 1 (autosomal dominant)
  ENSP ID: ENSP00000409084
  MOD_RES (1)..(1): Any amino acid
XYLILGSAVGGGYTAKKTFDQWKDMIPDLSEYKWIVPDIVWEIDEYIDFEKIRKALPSSEDLVKLAPDFDKIVESLSLLKDFFTSGHKLVSEVIGASDLLLLLGSPEETAFRATDRGSESDKHFRKVSDKEKIDQLQEELLHTQLKYQRILERLEKENKELRKLVLQKDDKGIHHRKLKKSLIDM

SEQ ID NO: 60204 - protein, 131 aa, Homo sapiens
  Payload ID: 12046
  Gene Symbol: OPA1
  Gene Name: optic atrophy 1 (autosomal dominant)
  ENSP ID: ENSP00000411699
  MOD_RES (1)..(1): Any amino acid
XLEKNVKEVLEDFAEDGEKKIKLLTGKRVQLAEDLTRTQHYTPGHHMAPHPALTLLLPCLGSDIRARLLFVMESLLLSSALTLCARCLSISSFPPASLCPTPDRFLPHLKPDHAFVEIPSLPCLCFASLHQ

SEQ ID NO: 60205 - protein, 179 aa, Homo sapiens
  Payload ID: 12047
  Gene Symbol: OPA3
  Gene Name: optic atrophy 3 (autosomal recessive, with chorea and spastic paraplegia)
  Uniprot ID: Q9H6K4
  ENSP ID: ENSP00000263275
MVVGAFPMAKLLYLGIRQVSKPLANRIKEAARRSEFFKTYICLPPAQLYHWVEMRTKMRIMGFRGTVIKPLNEEAAAELGAELLGEATIFIVGGGCLVLEYWRHQAQQRHKEEEQRAAWNALRDEVGHLALALEALQAQVQAAPPQGALEELRTELQEVRAQLCNPGRSASHAVPASKK

SEQ ID NO: 60206 - protein, 180 aa, Homo sapiens
  Payload ID: 12047
  Gene Symbol: OPA3
  Gene Name: optic atrophy 3 (autosomal recessive, with chorea and spastic paraplegia)
  Uniprot ID: Q9H6K4
  ENSP ID: ENSP00000319817
MVVGAFPMAKLLYLGIRQVSKPLANRIKEAARRSEFFKTYICLPPAQLYHWLEMRTKMRIMGFNAAAIKPLNEGAAAELGAELLGEGIIFITACSCLMLEYWRHQLQQRRKEKERRVAREALRGEVGHLGLALEELQAQVQATSTQLALEELRAQLQEVRAHLCLRDPPPAPPVAPASEK

SEQ ID NO: 60207 - protein, 126 aa, Homo sapiens
  Payload ID: 12047
  Gene Symbol: OPA3
  Gene Name: optic atrophy 3 (autosomal recessive, with chorea and spastic paraplegia)
  ENSP ID: ENSP00000442839
MRTKMRIMGFRGTVIKPLNEEAAAELGAELLGEATIFIVGGGCLVLEYWRHQAQQRHKEEEQRAAWNALRDEVGHLALALEALQAQVQAAPPQGALEELRTELQEVRAQLCNPGRSASHAVPASKK

SEQ ID NO: 60208 - protein, 332 aa, Homo sapiens
  Payload ID: 12048
  Gene Symbol: OPTC
  Gene Name: opticin
  Uniprot ID: Q9UBM4
  ENSP ID: ENSP00000356191
MRLLAFLSLLALVLQETGTASLPRKERKRREEQMPREGDSFEVLPLRNDVLNPDNYGEVIDLSNYEELTDYGDQLPEVKVTSLAPATSISPAKSTTAPGTPSSNPTMTRPTTAGLLLSSQPNHGLPTCLVCVCLGSSVYCDDIDLEDIPPLPRRTAYLYARFNRISRIRAEDFKGLTKLKRIDLSNNLISSIDNDAFRLLHALQDLILPENQLEALPVLPSGIEFLDVRLNRLQSSGIQPAAFRAMEKLQFLYLSDNLLDSIPGPLPLSLRSVHLQNNLIETMQRDVFCDPEEHKHTRRQLEDIRLDGNPINLSLFPSAYFCLPRLPIGRFT

SEQ ID NO: 60209 - protein, 174 aa, Homo sapiens
  Payload ID: 12048
  Gene Symbol: OPTC
  Gene Name: opticin
  ENSP ID: ENSP00000399491
MRLLAFLSLLALVLQETGTASLPRKERKRREEQMPREGDSFEVLPLRNDVLNPDNYGEVIDLSNYEELTDYGDQLPEVKVTSLAPATSISPAKSTTAPGTPSSNPTMTRPTTAGLLLSSQPNHEDIPPLPRRTAYLYARFNRISRIRAEDFKGLTKLKRIDLSNNLISSIDNDA

SEQ ID NO: 60210 - protein, 577 aa, Homo sapiens
  Payload ID: 12049
  Gene Symbol: OPTN
  Gene Name: optineurin
  Uniprot ID: Q96CV9
  ENSP ID: ENSP00000263036
MSHQPLSCLTEKEDSPSESTGNGPPHLAHPNLDTFTPEELLQQMKELLTENHQLKEAMKLNNQAMKGRFEELSAWTEKQKEERQFFEIQSKEAKERLMALSHENEKLKEELGKLKGKSERSSEDPTDDSRLPRAEAEQEKDQLRTQVVRLQAEKADLLGIVSELQLKLNSSGSSEDSFVEIRMAEGEAEGSVKEIKHSPGPTRTVSTGTALSKYRSRSADGAKNYFEHEELTVSQLLLCLREGNQKVERLEVALKEAKERVSDFEKKTSNRSEIETQTEGSTEKENDEEKGPETVGSEVEALNLQVTSLFKELQEAHTKLSEAELMKKRLQEKCQALERKNSAIPSELNEKQELVYTNKKLELQVESMLSEIKMEQAKTEDEKSKLTVLQMTHNKLLQEHNNALKTIEELTRKESEKVDRAVLKELSEKLELAEKALASKQLQMDEMKQTIAKQEEDLETMTILRAQMEVYCSDFHAERAAREKIHEEKEQLALQLAVLLKENDAFEDGGRQSLMEMQSRHGARTSDSDQQAYLVQRGAEDRDWRQQRNIPIHSCPKCGEVLPDIDTLQIHVMDCII

SEQ ID NO: 60211 - protein, 577 aa, Homo sapiens; identical to SEQ ID NO: 60210
  Payload ID: 12049
  Gene Symbol: OPTN
  Gene Name: optineurin
  Uniprot ID: Q96CV9
  ENSP ID: ENSP00000368021

SEQ ID NO: 60212 - protein, 577 aa, Homo sapiens; identical to SEQ ID NO: 60210
  Payload ID: 12049
  Gene Symbol: OPTN
  Gene Name: optineurin
  Uniprot ID: Q96CV9
  ENSP ID: ENSP00000368022

SEQ ID NO: 60213 - protein, 571 aa, Homo sapiens
  Payload ID: 12049
  Gene Symbol: OPTN
  Gene Name: optineurin
  Uniprot ID: Q96CV9
  ENSP ID: ENSP00000368027
MSHQPLSCLTEKEDSPSESTGNGPPHLAHPNLDTFTPEELLQQMKELLTENHQLKEAMKLNNQAMKGRFEELSAWTEKQKEERQFFEIQSKEAKERLMALSHENEKLKEELGKLKGKSERSSEDPTDDSRLPRAEAEQEKDQLRTQVVRLQAEKADLLGIVSELQLKLNSSGSSEDSFVEIRMAEGEAEGSVKEIKHSPGPTRTVSTGTSRSADGAKNYFEHEELTVSQLLLCLREGNQKVERLEVALKEAKERVSDFEKKTSNRSEIETQTEGSTEKENDEEKGPETVGSEVEALNLQVTSLFKELQEAHTKLSEAELMKKRLQEKCQALERKNSAIPSELNEKQELVYTNKKLELQVESMLSEIKMEQAKTEDEKSKLTVLQMTHNKLLQEHNNALKTIEELTRKESEKVDRAVLKELSEKLELAEKALASKQLQMDEMKQTIAKQEEDLETMTILRAQMEVYCSDFHAERAAREKIHEEKEQLALQLAVLLKENDAFEDGGRQSLMEMQSRHGARTSDSDQQAYLVQRGAEDRDWRQQRNIPIHSCPKCGEVLPDIDTLQIHVMDCII

SEQ ID NO: 60214 - protein, 577 aa, Homo sapiens; identical to SEQ ID NO: 60210
  Payload ID: 12049
  Gene Symbol: OPTN
  Gene Name: optineurin
  Uniprot ID: Q96CV9
  ENSP ID: ENSP00000368032

SEQ ID NO: 60215 - protein, 571 aa, Homo sapiens; identical to SEQ ID NO: 60213
  Payload ID: 12049
  Gene Symbol: OPTN
  Gene Name: optineurin
  Uniprot ID: Q96CV9
  ENSP ID: ENSP00000368040

SEQ ID NO: 60216 - protein, 126 aa, Homo sapiens
  Payload ID: 12049
  Gene Symbol: OPTN
  Gene Name: optineurin
  ENSP ID: ENSP00000400356
  MOD_RES (1)..(1): Any amino acid
XGEAEGSVKEIKHSPGPTRTVSTGTALSKYRSRSADGAKNYFEHEELTVSQLLLCLREGNQKVERLEVALKEAKERVSDFEKKTSNRSEIETQTEGSTEKENDEEKGPETTGFHHVGQDGLDLLTS

SEQ ID NO: 60217 - protein, 62 aa, Homo sapiens
  Payload ID: 12049
  Gene Symbol: OPTN
  Gene Name: optineurin
  ENSP ID: ENSP00000414747
MSHQPLSCLTEKEDSPSESTGNGPPHLAHPNLDTFTPEELLQQMKELLTENHQLKEPCGQVD

SEQ ID NO: 60218 - protein, 107 aa, Homo sapiens
  Payload ID: 12049
  Gene Symbol: OPTN
  Gene Name: optineurin
  ENSP ID: ENSP00000481473
  MOD_RES (1)..(1): Any amino acid
XAEQEKDQLRTQVVRLQAEKADLLGIVSELQLKLNSSGSSEDSFVEIRMAEGEAEGSVKEIKHSPGPTRTVSTGTYVKEDSGCQADRLGRLVTGCLSPEVKCCDLRK

SEQ ID NO: 60219 - protein, 58 aa, Homo sapiens
  Payload ID: 12049
  Gene Symbol: OPTN
  Gene Name: optineurin
  ENSP ID: ENSP00000484961
MSHQPLSCLTEKEDSPSESTGNGPPHLAHPNLDTFTPEELLQQMKELLTENHQLKGPH

SEQ ID NO: 60220 - protein, 318 aa, Homo sapiens; identical to SEQ ID NO: 59453
  Payload ID: 12050
  Gene Symbol:
  Gene Name: OR1B1
  ENSP ID: ENSP00000485111

SEQ ID NO: 60221 - protein, 318 aa, Homo sapiens; identical to SEQ ID NO: 59453
  Payload ID: 12050
  Gene Symbol:
  Gene Name: OR1B1
  ENSP ID: ENSP00000485577

SEQ ID NO: 60222 - protein, 312 aa, Homo sapiens; identical to SEQ ID NO: 59727
  Payload ID: 12051
  Gene Symbol:
  Gene Name: OR2L8
  ENSP ID: ENSP00000485287

SEQ ID NO: 60223 - protein, 321 aa, Homo sapiens; identical to SEQ ID NO: 59932
  Payload ID: 12052
  Gene Symbol:
  Gene Name: OR51G1
  ENSP ID: ENSP00000485265

SEQ ID NO: 60224 - protein, 321 aa, Homo sapiens; identical to SEQ ID NO: 59932
  Payload ID: 12052
  Gene Symbol:
  Gene Name: OR51G1
  ENSP ID: ENSP00000485612

SEQ ID NO: 60225 - protein, 305 aa, Homo sapiens
  Payload ID: 12053
  Gene Symbol:
  Gene Name: OR52E1
  ENSP ID: ENSP00000476576
MNTTLFHPYSFLLLGIPGLESMHLWVGFPFFAVFLTAVLGNITILFVIQTDSSLHHPMFYFLAILSSIDPGLSTSTIPKMLGTFWFTLREISFEGCLTQMFFIHLCTGMESAVLVAMAYDCYVAICDPLCYTLVLTNKVVSVMALAIFLRPLVFVIPFVLFILRLPFCGHQIIPHTYGEHMGIARLSCASIRVNIIYGLCAISILVFDIIAIVISYVQILCAVFLLSSHDARLKAFSTCGSHVCVMLTFYMPAFFSFMTIGLVGIYLTLSTFFWLISMSFHLLSTLFMVSEPNRLEHKCKCFSIN

SEQ ID NO: 60226 - protein, 318 aa, Homo sapiens
  Payload ID: 12054
  Gene Symbol:
  Gene Name: OR5AL1
  ENSP ID: ENSP00000477393
MCALKGFLEENFYTYSVAKGNHSTVYEFILLGLTDNAELQVTLFGIFLVVYLASFMGNFGLIMLIQISPQLHTPMYFFLSHLAFVDFSFTSSVAPNTLVNFLCEVKSITFYACAIQVCCFITFVVCELYLLSIMAYDRYVAICNPLLYVILIPRKLYTDCHVCVWIHCGTCTDSGDILLVFLFQRDQPLLPCSISGSGLFHSCQRADVVNHCWVQYSLLSSNCADFLWFHFLCHPEDTFCRETESIFYQCFPSDLHHNILWNNHFYVPAAQVKPFPEYGSCFCVCGSDSYIKPTDLFKKSGGKKCTKENYRKVMFGCQ

SEQ ID NO: 60227 - protein, 314 aa, Homo sapiens; identical to SEQ ID NO: 59859
  Payload ID: 12055
  Gene Symbol:
  Gene Name: OR5D13
  ENSP ID: ENSP00000485050

SEQ ID NO: 60228 - protein, 314 aa, Homo sapiens; identical to SEQ ID NO: 59859
  Payload ID: 12055
  Gene Symbol:
  Gene Name: OR5D13
  ENSP ID: ENSP00000485428

SEQ ID NO: 60229 - protein, 89 aa, Homo sapiens
  Payload ID: 12056
  Gene Symbol: ORAI1
  Gene Name: ORAI calcium release-activated calcium modulator 1
  ENSP ID: ENSP00000477953
MSLNEHSMQALSWRKLYLSRAKLKASSRTSALLSGFAMVSSGRPALPPLLSRLLPPAAPTGLSGRAGRARVRGRAGRNRGGNGGGAAGR

SEQ ID NO: 60230 - protein, 301 aa, Homo sapiens
  Payload ID: 12056
  Gene Symbol: ORAI1
  Gene Name: ORAI calcium release-activated calcium modulator 1
  Uniprot ID: Q96D31
  ENSP ID: ENSP00000480616
MHPEPAPPPSRSSPELPPSGGSTTSGSRRSRRRSGDGEPPGAPPPPPSAVTYPDWIGQSYSEVMSLNEHSMQALSWRKLYLSRAKLKASSRTSALLSGFAMVAMVEVQLDADHDYPPGLLIAFSACTTVLVAVHLFALMISTCILPNIEAVSNVHNLNSVKESPHERMHRHIELAWAFSTVIGTLLFLAEVVLLCWVKFLPLKKQPGQPRPTSKPPASGAAANVSTSGITPGQAAAIASTTIMVPFGLIFIVFAVHFYRSLVSHKTDRQFQELNELAEFARLQDQLDHRGDHPLTPGSHYA

SEQ ID NO: 60231 - protein, 238 aa, Homo sapiens
  Payload ID: 12056
  Gene Symbol: ORAI1
  Gene Name: ORAI calcium release-activated calcium modulator 1
  ENSP ID: ENSP00000482568
MSLNEHSMQALSWRKLYLSRAKLKASSRTSALLSGFAMVAMVEVQLDADHDYPPGLLIAFSACTTVLVAVHLFALMISTCILPNIEAVSNVHNLNSVKESPHERMHRHIELAWAFSTVIGTLLFLAEVVLLCWVKFLPLKKQPGQPRPTSKPPASGAAANVSTSGITPGQAAAIASTTIMVPFGLIFIVFAVHFYRSLVSHKTDRQFQELNELAEFARLQDQLDHRGDHPLTPGSHYA

SEQ ID NO: 60232 - protein, 254 aa, Homo sapiens
  Payload ID: 12057
  Gene Symbol: ORAI2
  Gene Name: ORAI calcium release-activated calcium modulator 2
  Uniprot ID: Q96SN7
  ENSP ID: ENSP00000348752
MSAELNVPIDPSAPACPEPGHKGMDYRDWVRRSYLELVTSNHHSVQALSWRKLYLSRAKLKASSRTSALLSGFAMVAMVEVQLETQYQYPRPLLIAFSACTTVLVAVHLFALLISTCILPNVEAVSNIHNLNSISESPHERMHPYIELAWGFSTVLGILLFLAEVVLLCWIKFLPVDARRQPGPPPGPGSHTGWQAALVSTIIMVPVGLIFVVFTIHFYRSLVRHKTERHNREIEELHKLKVQLDGHERSLQVL

SEQ ID NO: 60233 - protein, 254 aa, Homo sapiens; identical to SEQ ID NO: 60232
  Payload ID: 12057
  Gene Symbol: ORAI2
  Gene Name: ORAI calcium release-activated calcium modulator 2
  Uniprot ID: Q96SN7
  ENSP ID: ENSP00000385489

SEQ ID NO: 60234 - protein, 212 aa, Homo sapiens
  Payload ID: 12057
  Gene Symbol: ORAI2
  Gene Name: ORAI calcium release-activated calcium modulator 2
  ENSP ID: ENSP00000417407
MSAELNVPIDPSAPACPEPGHKGMDYRDWVRRSYLELVTSNHHSVQALSWRKLYLSRAKLKASSRTSALLSGFAMVAMVEVQLETQYQYPRPLLIAFSACTTVLVAVHLFALLISTCILPNVEAVSNIHNLNSISESPHERMHPYIELAWGFSTVLGILLFLAEVVLLCWIKFLPVDARRQPGPPPGPGSHTGWQAALVSTIIMVPVGLIFV

SEQ ID NO: 60235 - protein, 254 aa, Homo sapiens; identical to SEQ ID NO: 60232
  Payload ID: 12057
  Gene Symbol: ORAI2
  Gene Name: ORAI calcium release-activated calcium modulator 2
  Uniprot ID: Q96SN7
  ENSP ID: ENSP00000417928

SEQ ID NO: 60236 - protein, 254 aa, Homo sapiens; identical to SEQ ID NO: 60232
  Payload ID: 12057
  Gene Symbol: ORAI2
  Gene Name: ORAI calcium release-activated calcium modulator 2
  Uniprot ID: Q96SN7
  ENSP ID: ENSP00000418140

SEQ ID NO: 60237 - protein, 97 aa, Homo sapiens
  Payload ID: 12057
  Gene Symbol: ORAI2
  Gene Name: ORAI calcium release-activated calcium modulator 2
  ENSP ID: ENSP00000418464
MSAELNVPIDPSAPACPEPGHKGMDYRDWVRRSYLELVTSNHHSVQALSWRKLYLSRAKLKASSRTSALLSGFAMVAMVEVQLETQYQYPRPLLIAF

SEQ ID NO: 60238 - protein, 30 aa, Homo sapiens
  Payload ID: 12057
  Gene Symbol: ORAI2
  Gene Name: ORAI calcium release-activated calcium modulator 2
  ENSP ID: ENSP00000419416
MSAELNVPIDPSAPACPEPGHKGMDYRDWV

SEQ ID NO: 60239 - protein, 229 aa, Homo sapiens
  Payload ID: 12057
  Gene Symbol: ORAI2
  Gene Name: ORAI calcium release-activated calcium modulator 2
  ENSP ID: ENSP00000420178
MSAELNVPIDPSAPACPEPGHKGMDYRDWVRRSYLELVTSNHHSVQALSWRKLYLSRAKLKASSRTSALLSGFAMVAMVEVQLETQYQYPRPLLIAFSACTTVLVAVHLFALLISTCILPNVEAVSNIHNLNSISESPHERMHPYIELAWGFSTVLGILLFLAEVVLLCWIKFLPVDARRQPGPPPGPGSHTGWQAALVSTIIMVPVGLIFVVFTIHFYRSLVRHKTER

SEQ ID NO: 60240 - protein, 254 aa, Homo sapiens; identical to SEQ ID NO: 60232
  Payload ID: 12057
  Gene Symbol: ORAI2
  Gene Name: ORAI calcium release-activated calcium modulator 2
  Uniprot ID: Q96SN7
  ENSP ID: ENSP00000478113

SEQ ID NO: 60241 - protein, 295 aa, Homo sapiens [sequence omitted]

SEQ ID NO: 60242 - protein, 77 aa, Homo sapiens
  Payload ID: 12058
  Gene Symbol: ORAI3
  Gene Name: ORAI calcium release-activated calcium modulator 3
  ENSP ID: ENSP00000457025
MKGGEGDAGEQAPLNPEGESPAGSATYREFVHRGYLDLMGASQHSLRALSWRRLYLSRAKLKASSRTSALLSGFAMR

SEQ ID NO: 60243 - protein, 98 aa, Homo sapiens
  Payload ID: 12058
  Gene Symbol: ORAI3
  Gene Name: ORAI calcium release-activated calcium modulator 3
  ENSP ID: ENSP00000457221
MKGGEGDAGEQAPLNPEGESPAGSATYREFVHRGYLDLMGASQHSLRALSWRRLYLSRAKLKASSRTSALLSGFAMGTPGDGATGGHESPKGVVVGVG

SEQ ID NO: 60244 - protein, 280 aa, Homo sapiens
  Payload ID: 12058
  Gene Symbol: ORAI3
  Gene Name: ORAI calcium release-activated calcium modulator 3
  ENSP ID: ENSP00000457388
MKGGEGDAGEQAPLNPEGESPAGSATYREFVHRGYLDLMGASQHSLRALSWRRLYLSRAKLKASSRTSALLSGFAMVAMVEVQLESDHEYPPGLLVAFSACTTVLVAVHLFALMVSTCLLPHIEAVSNIHNLNSVHQSPHQRLHRYVELAWGFSTALGTFLFLAEVVLVGWVKFVPIGAPLDTPTPMVPTSRVPGTLAPVATSLSPASNLPRSSASAAPSQAEPACPPRQACGGGGAHGPGWQAAMASTAIMGFSPSVCPLGFASYSAPGLASVEGSCSR

SEQ ID NO: 60245 - protein, 137 aa, Homo sapiens
  Payload ID: 12059
  Gene Symbol: ORAOV1
  Gene Name: oral cancer overexpressed 1
  Uniprot ID: Q8WV07
  ENSP ID: ENSP00000279147
MAGSQDIFDAIVMADERFHGEGYREGYEEGSSLGVMEGRQHGTLHGAKIGSEIGCYQGFAFAWKCLLHSCTTEKDSRKMKVLESLIGMIQKFPYDDPTYDKLHEDLDKIRGKFKQFCSLLNVQPDFKISAEGSGLSF

SEQ ID NO: 60246 - protein, 70 aa, Homo sapiens
  Payload ID: 12059
  Gene Symbol: ORAOV1
  Gene Name: oral cancer overexpressed 1
  ENSP ID: ENSP00000409643
MAGSQDIFDAIVMADERFHGEGYREGYEEGSSLGVMEGRQHGTLHGAKIGSEQKDEGLRIIDWNDPEIPL

SEQ ID NO: 60247 - protein, 76 aa, Homo sapiens
  Payload ID: 12059
  Gene Symbol: ORAOV1
  Gene Name: oral cancer overexpressed 1
  ENSP ID: ENSP00000437367
MAGSQDIFDAIVMADERFHGEGYREGYEEGSSLGVMEGRQHGTLHGAKIGSEIGCYQGFAFAWKCLLHSCTTEKDR

SEQ ID NO: 60248 - protein, 78 aa, Homo sapiens
  Payload ID: 12059
  Gene Symbol: ORAOV1
  Gene Name: oral cancer overexpressed 1
  ENSP ID: ENSP00000441984
MAGSQDIFDAIVMADESRKMKVLESLIGMIQKFPYDDPTYDKLHEDLDKIRGKFKQFCSLLNVQPDFKISAEGSGLSF

SEQ ID NO: 60249 - protein, 36 aa, Homo sapiens
  Payload ID: 12059
  Gene Symbol: ORAOV1
  Gene Name: oral cancer overexpressed 1
  ENSP ID: ENSP00000443669
MAGSQDIFDAIVMADERAPGEPLVLRQWGSCELPPG

SEQ ID NO: 60250 - protein, 43 aa, Homo sapiens
  Payload ID: 12059
  Gene Symbol: ORAOV1
  Gene Name: oral cancer overexpressed 1
  ENSP ID: ENSP00000443936
MAGSQDIFDAIVMADERSGATKVLLLHGNVYCTVAPLRRTAER

SEQ ID NO: 60251 - protein, 124 aa, Homo sapiens
  Payload ID: 12059
  Gene Symbol: ORAOV1
  Gene Name: oral cancer overexpressed 1
  ENSP ID: ENSP00000444112
MAGSQDIFDAIVMADERFHGEGYREGYEEGSSLGVMEGRQHGTLHGAKIGSEIGCYQGFAFAWKCLLHSCTTEKDSRKMKVLESLIGMIQKFPYDDPTYDKLHEDLDKIRGKFKQVRALCVSSC

SEQ ID NO: 60252 - protein, 137 aa, Homo sapiens; identical to SEQ ID NO: 60245
  Payload ID: 12059
  Gene Symbol: ORAOV1
  Gene Name: oral cancer overexpressed 1
  Uniprot ID: Q8WV07
  ENSP ID: ENSP00000446129

SEQ ID NO: 60253 - protein, 221 aa, Homo sapiens
  Payload ID: 12059
  Gene Symbol: ORAOV1
  Gene Name: oral cancer overexpressed 1
  ENSP ID: ENSP00000446428
MAGSQDIFDAIVMADERFHGEGYREGYEEGSSLGVMEGRQHGTLHGAKIGSEIGCYQGFAFAWKCLLHSCTTEKDSRKMKVLESLIGMIQKFPYDDPTYDKLHEDLDKIRGKFKQTGLSPSAVMVRPPSYVELPVTCWCWEAPRCNQKCTDPAARRPDPQTCASQDRLRCAPCTCHQPLASRYTQHPGLVPLPHHDRQSVPQGPRVVQTDAAARMVEQQTM

SEQ ID NO: 60254 - protein, 62 aa, Homo sapiens
  Payload ID: 12059
  Gene Symbol: ORAOV1
  Gene Name: oral cancer overexpressed 1
  ENSP ID: ENSP00000455359
  MOD_RES (1)..(1): Any amino acid
XRKMKVLESLIGMIQKFPYDDPTYDKLHEDLDKIRGKFKQFCSLLNVQPDFKISAEGSGLSF

SEQ ID NO: 60255 - protein, 1012 aa, Homo sapiens
  Payload ID: 12060
  Gene Symbol: OFD1
  Gene Name: oral-facial-digital syndrome 1
  Uniprot ID: O75665
  ENSP ID: ENSP00000344314
MMAQSNMFTVADVLSQDELRKKLYQTFKDRGILDTLKTQLRNQLIHELMHPVLSGELQPRSISVEGSSLLIGASNSLVADHLQRCGYEYSLSVFFPESGLAKEKVFTMQDLLQLIKINPTSSLYKSLVSGSDKENQKGFLMHFLKELAEYHQAKESCNMETQTSSTFNRDSLAEKLQLIDDQFADAYPQRIKFESLEIKLNEYKREIEEQLRAEMCQKLKFFKDTEIAKIKMEAKKKYEKELTMFQNDFEKACQAKSEALVLREKSTLERIHKHQEIETKEIYAQRQLLLKDMDLLRGREAELKQRVEAFELNQKLQEEKHKSITEALRRQEQNIKSFEETYDRKLKNELLKYQLELKDDYIIRTNRLIEDERKNKEKAVHLQEELIAINSKKEELNQSVNRVKELELELESVKAQSLAITKQNHMLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTQVADLKLQLKQTQTALENEVYCNPKQSVIDRSVNGLINGNVVPCNGEISGDFLNNPFKQENVLARMVASRITNYPTAWVEGSSPDSDLEFVANTKARVKELQQEAERLEKAFRSYHRRVIKNSAKSPLAAKSPPSLHLLEAFKNITSSSPERHIFGEDRVVSEQPQVGTLEERNDVVEALTGSAASRLRGGTSSRRLSSTPLPKAKRSLESEMYLEGLGRSHIASPSPCPDRMPLPSPTESRHSLSIPPVSSPPEQKVGLYRRQTELQDKSEFSDVDKLAFKDNEEFESSFESAGNMPRQLEMGGLSPAGDMSHVDAAAAAVPLSYQHPSVDQKQIEEQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 60256 - protein, 972 aa, Homo sapiens
  Payload ID: 12060
  Gene Symbol: OFD1
  Gene Name: oral-facial-digital syndrome 1
  Uniprot ID: O75665
  ENSP ID: ENSP00000369923
MMAQSNMFTVADVLSQDELRKKLYQTFKDRGILDTLKTQLRNQLIHELMHPVLSGELQPRSISVEGSSLLIGASNSLVADHLQRCGYEYSLSVFFPESGLAKEKVFTMQDLLQLIKINPTSSLYKSLVSGSDKENQKGFLMHFLKELAEYHQAKESCNMETQTSSTFNRDSLAEKLQLIDDQFADAYPQRIKFESLEIKLNEYKREIEEQLRAEMCQKLKFFKDTEIAKIKMEAKKKYEKELTMFQNDFEKACQAKSEALVLREKSTLERIHKHQEIETKEIYAQRQLLLKDMDLLRGREAELKQRVEAFELYQLELKDDYIIRTNRLIEDERKNKEKAVHLQEELIAINSKKEELNQSVNRVKELELELESVKAQSLAITKQNHMLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTQVADLKLQLKQTQTALENEVYCNPKQSVIDRSVNGLINGNVVPCNGEISGDFLNNPFKQENVLARMVASRITNYPTAWVEGSSPDSDLEFVANTKARVKELQQEAERLEKAFRSYHRRVIKNSAKSPLAAKSPPSLHLLEAFKNITSSSPERHIFGEDRVVSEQPQVGTLEERNDVVEALTGSAASRLRGGTSSRRLSSTPLPKAKRSLESEMYLEGLGRSHIASPSPCPDRMPLPSPTESRHSLSIPPVSSPPEQKVGLYRRQTELQDKSEFSDVDKLAFKDNEEFESSFESAGNMPRQLEMGGLSPAGDMSHVDAAAAAVPLSYQHPSVDQKQIEEQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 60257 - protein, 872 aa, Homo sapiens
  Payload ID: 12060
  Gene Symbol: OFD1
  Gene Name: oral-facial-digital syndrome 1
  ENSP ID: ENSP00000369941
MHFLKELAEYHQAKESCNMETQTSSTFNRDSLAEKLQLIDDQFADAYPQRIKFESLEIKLNEYKREIEEQLRAEMCQKLKFFKDTEIAKIKMEAKKKYEKELTMFQNDFEKACQAKSEALVLREKSTLERIHKHQEIETKEIYAQRQLLLKDMDLLRGREAELKQRVEAFELNQKLQEEKHKSITEALRRQEQNIKSFEETYDRKLKNELLKYQLELKDDYIIRTNRLIEDERKNKEKAVHLQEELIAINSKKEELNQSVNRVKELELELESVKAQSLAITKQNHMLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTQVADLKLQLKQTQTALENEVYCNPKQSVIDRSVNGLINGNVVPCNGEISGDFLNNPFKQENVLARMVASRITNYPTAWVEGSSPDSDLEFVANTKARVKELQQEAERLEKAFRSYHRRVIKNSAKSPLAAKSPPSLHLLEAFKNITSSSPERHIFGEDRVVSEQPQVGTLEERNDVVEALTGSAASRLRGGTSSRRLSSTPLPKAKRSLESEMYLEGLGRSHIASPSPCPDRMPLPSPTESRHSLSIPPVSSPPEQKVGLYRRQTELQDKSEFSDVDKLAFKDNEEFESSFESAGNMPRQLEMGGLSPAGDMSHVDAAAAAVPLSYQHPSVDQKQIEEQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 60258 - protein, 338 aa, Homo sapiens [sequence omitted]

SEQ ID NO: 60259 - protein, 379 aa, Homo sapiens
  Payload ID: 12061
  Gene Symbol: OSCP1
  Gene Name: organic solute carrier partner 1
  Uniprot ID: Q8WVF1
  ENSP ID: ENSP00000235532
MSVRTLPLLFLNLGGEMLYILDQRLRAQNIPGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQESIAPNPLAKEELNFLARLMGGMEIKKPSGPEPGFRLNLFTTDEEEEQAALTRPEELSYEVINIQATQDQQRSEELARIMGEFEITEQPRLSTSKGDDLLAMMDEL

SEQ ID NO: 60260 - protein, 223 aa, Homo sapiens
  Payload ID: 12061
  Gene Symbol: OSCP1
  Gene Name: organic solute carrier partner 1
  Uniprot ID: Q8WVF1
  ENSP ID: ENSP00000346216
MSVRTLPLLFLNLGGEMLYILDQRLRAQNIPGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRRECFWKHMQETVHSAQCCLPGVGNYMEDRRRRLTFHYVYPFENFEFCTWAK

SEQ ID NO: 60261 - protein, 389 aa, Homo sapiens
  Payload ID: 12061
  Gene Symbol: OSCP1
  Gene Name: organic solute carrier partner 1
  Uniprot ID: Q8WVF1
  ENSP ID: ENSP00000349052
MSVRTLPLLFLNLGGEMLYILDQRLRAQNIPGDKARKDEWTEVDRKRVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQESIAPNPLAKEELNFLARLMGGMEIKKPSGPEPGFRLNLFTTDEEEEQAALTRPEELSYEVINIQATQDQQRSEELARIMGEFEITEQPRLSTSKGDDLLAMMDEL

SEQ ID NO: 60262 - protein, 334 aa, Homo sapiens
  Payload ID: 12061
  Gene Symbol: OSCP1
  Gene Name: organic solute carrier partner 1
  ENSP ID: ENSP00000390820
MFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQESIAPNPLAKEELNFLARLMGGMEIKKPSGPEPGFRLNLFTTDEEEEQAALTRPEELSYEVINIQATQDQQRSEELARIMGEFEITEQPRLSTSKGDDLLAMMDEL

SEQ ID NO: 60263 - protein, 255 aa, Homo sapiens
  Payload ID: 12061
  Gene Symbol: OSCP1
  Gene Name: organic solute carrier partner 1
  ENSP ID: ENSP00000396417
PGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQTSSANQARRVIL

SEQ ID NO: 60264 - protein, 94 aa, Homo sapiens
  Payload ID: 12061
  Gene Symbol: OSCP1
  Gene Name: organic solute carrier partner 1
  ENSP ID: ENSP00000426981
  MOD_RES (1)..(1): Any amino acid
XSSKNLASWTQESIAPNPLAKEELNFLARLMGGMEIKKPSGPEPGFRLNLFTTDEEEEQAALTRPEELSYEVINIQATQSLFSNLATIQGGLTG

SEQ ID NO: 60265 - protein, 13 aa, Homo sapiens
  Payload ID: 12061
  Gene Symbol: OSCP1
  Gene Name: organic solute carrier partner 1
  ENSP ID: ENSP00000434268
  MOD_RES (1)..(1): Any amino acid
XNIPGDKARKDFD

SEQ ID NO: 60266 - protein, 861 aa, Homo sapiens
  Payload ID: 12062
  Gene Symbol: ORC1
  Gene Name: origin recognition complex, subunit 1
  Uniprot ID: Q13415
  ENSP ID: ENSP00000360621
MAHYPTRLKTRKTYSWVGRPLLDRKLHYQTYREMCVKTEGCSTEIHIQIGQFVLIEGDDDENPYVAKLLELFEDDSDPPPKKRARVQWFVRFCEVPACKRHLLGRKPGAQEIFWYDYPACDSNINAETIIGLVRVIPLAPKDVVPTNLKNEKTLFVKLSWNEKKFRPLSSELFAELNKPQESAAKCQKPVRAKSKSAESPSWTPAEHVAKRIESRHSASKSRQTPTHPLTPRARKRLELGNLGNPQMSQQTSCASLDSPGRIKRKVAFSEITSPSKRSQPDKLQTLSPALKAPEKTRETGLSYTEDDKKASPEHRIILRTRIAASKTIDIREERTLTPISGGQRSSVVPSVILKPENIKKRDAKEAKAQNEATSTPHRIRRKSSVLTMNRIRQQLRFLGNSKSDQEEKEILPAAEISDSSSDEEEASTPPLPRRAPRTVSRNLRSSLKSSLHTLTKVPKKSLKPRTPRCAAPQIRSRSLAAQEPASVLEEARLRLHVSAVPESLPCREQEFQDIYNFVESKLLDHTGGCMYISGVPGTGKTATVHEVIRCLQQAAQANDVPPFQYIEVNGMKLTEPHQVYVQILQKLTGQKATANHAAELLAKQFCTRGSPQETTVLLVDELDLLWTHKQDIMYNLFDWPTHKEARLVVLAIANTMDLPERIMMNRVSSRLGLTRMCFQPYTYSQLQQILRSRLKHLKAFEDDAIQLVARKVAALSGDARRCLDICRRATEICEFSQQKPDSPGLVTIAHSMEAVDEMFSSSYITAIKNSSVLEQSFLRAILAEFRRSGLEEATFQQIYSQHVALCRMEGLPYPTMSETMAVCSHLGSCRLLLVEPSRNDLLLRVRLNVSQDDVLYALKDE

SEQ ID NO: 60267 - protein, 861 aa, Homo sapiens; identical to SEQ ID NO: 60266
  Payload ID: 12062
  Gene Symbol: ORC1
  Gene Name: origin recognition complex, subunit 1
  Uniprot ID: Q13415
  ENSP ID: ENSP00000360623

SEQ ID NO: 60268 - protein, 577 aa, Homo sapiens
  Payload ID: 12063
  Gene Symbol: ORC2
  Gene Name: origin recognition complex, subunit 2
  Uniprot ID: Q13416
  ENSP ID: ENSP00000234296
MSKPELKEDKMLEVHFVGDDDVLNHILDREGGAKLKKERAQLLVNPKKIIKKPEYDLEEDDQEVLKDQNYVEIMGRDVQESLKNGSATGGGNKVYSFQNRKHSEKMAKLASELAKTPQKSVSFSLKNDPEITINVPQSSKGHSASDKVQPKNNDKSEFLSTAPRSLRKRLIVPRSHSDSESEYSASNSEDDEGVAQEHEEDTNAVIFSQKIQAQNRVVSAPVGKETPSKRMKRDKTSDLVEEYFEAHSSSKVLTSDRTLQKLKRAKLDQQTLRNLLSKVSPSFSAELKQLNQQYEKLFHKWMLQLHLGFNIVLYGLGSKRDLLERFRTTMLQDSIHVVINGFFPGISVKSVLNSITEEVLDHMGTFRSILDQLDWIVNKFKEDSSLELFLLIHNLDSQMLRGEKSQQIIGQLSSLHNIYLIASIDHLNAPLMWDHAKQSLFNWLWYETTTYSPYTEETSYENSLLVKQSGSLPLSSLTHVLRSLTPNARGIFRLLIKYQLDNQDNPSYIGLSFQDFYQQCREAFLVNSDLTLRAQLTEFRDHKLIRTKKGTDGVEYLLIPVDNGTLTDFLEKEEEEA

SEQ ID NO: 60269 - protein, 109 aa, Homo sapiens
  Payload ID: 12063
  Gene Symbol: ORC2
  Gene Name: origin recognition complex, subunit 2
  ENSP ID: ENSP00000386390
MSKPELKEDKMLEVHFVGDDDVLNHILDREGGAKLKKERAQLLVNPKKIIKKPEYDLEEDDQEVLKDQNYVEIMGRDVQESLKNGSATGGGNKVYSFQNRKHSEKMAKL

SEQ ID NO: 60270 - protein, 72 aa, Homo sapiens
  Payload ID: 12063
  Gene Symbol: ORC2
  Gene Name: origin recognition complex, subunit 2
  ENSP ID: ENSP00000396641
MSKPELKEDKMLEVHFVGDDDVLNHILDREGGAKLKKERAQLLVNPKKIIKKPEYDLEEDDQEVLKDQNYVE

SEQ ID NO: 60271 - protein, 712 aa, Homo sapiens
  Payload ID: 12064
  Gene Symbol: ORC3
  Gene Name: origin recognition complex, subunit 3
  Uniprot ID: Q9UBD5
  ENSP ID: ENSP00000257789
MATSSMSKGCFVFKPNSKKRKISLPIEDYFNKGKNEPEDSKLRFETYQLIWQQMKSENERLQEELNKNLFDNLIEFLQKSHSGFQKNSRDLGGQIKLREIPTAALVLGVNVTDHDLTFGSLTEALQNNVTPYVVSLQAKDCPDMKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFKINEKVLQVLTNIFLYHDFSVQNFIKGLQLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRMLAKDELMTILEKCFKVFKSYCENHLGSTAKRIEEFLAQFQSLDAETKEEEDASGSQPKGLQKTDLYHLQKSLLEMKELRRSKKQTKFEVLRENVVNFIDCLVREYLLPPETQPLHEVVYFSAAHALREHLNAAPRIALHTALNNPYYYLKNEALKSEEGCIPNIAPDICIAYKLHLECSRLINLVDWSEAFATVVTAAEKMDANSATSEEMNEIIHARFIRAVSELELLGFIKPTKQKTDHVARLTWGGC

SEQ ID NO: 60272 - protein, 711 aa, Homo sapiens
  Payload ID: 12064
  Gene Symbol: ORC3
  Gene Name: origin recognition complex, subunit 3
  Uniprot ID: Q9UBD5
  ENSP ID: ENSP00000376586
MATSSMSKGCFVFKPNSKKRKISLPIEDYFNKGKNEPEDSKLRFETYQLIWQQMKSENERLQEELNKNLFDNLIEFLQKSHSGFQKNSRDLGGQIKLREIPTAALVLGVNVTDHDLTFGSLTEALQNNVTPYVVSLQAKDCPDMKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFKINEKVLQVLTNIFLYHDFSVQNFIKGLQLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRMLAKDELMTILEKCFKVFKSYCENHLGSTAKRIEEFLAQFQSLDETKEEEDASGSQPKGLQKTDLYHLQKSLLEMKELRRSKKQTKFEVLRENVVNFIDCLVREYLLPPETQPLHEVVYFSAAHALREHLNAAPRIALHTALNNPYYYLKNEALKSEEGCIPNIAPDICIAYKLHLECSRLINLVDWSEAFATVVTAAEKMDANSATSEEMNEIIHARFIRAVSELELLGFIKPTKQKTDHVARLTWGGC

SEQ ID NO: 60273 - protein, 568 aa, Homo sapiens
  Payload ID: 12064
  Gene Symbol: ORC3
  Gene Name: origin recognition complex, subunit 3
  Uniprot ID: Q9UBD5
  ENSP ID: ENSP00000444695
MKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFKINEKVLQVLTNIFLYHDFSVQNFIKGLQLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRMLAKDELMTILEKCFKVFKSYCENHLGSTAKRIEEFLAQFQSLDETKEEEDASGSQPKGLQKTDLYHLQKSLLEMKELRRSKKQTKFEVLRENVVNFIDCLVREYLLPPETQPLHEVVYFSAAHALREHLNAAPRIALHTALNNPYYYLKNEALKSEEGCIPNIAPDICIAYKLHLECSRLINLVDWSEAFATVVTAAEKMDANSATSEEMNEIIHARFIRAVSELELLGFIKPTKQKTDHVARLTWGGC

SEQ ID NO: 60274 - protein, 32 aa, Homo sapiens
  Payload ID: 12064
  Gene Symbol: ORC3
  Gene Name: origin recognition complex, subunit 3
  ENSP ID: ENSP00000475988
MLAKDELMTILEKCFKVFKSYCENHLGSTAKR

SEQ ID NO: 60275 - protein, 436 aa, Homo sapiens
  Payload ID: 12065
  Gene Symbol: ORC4
  Gene Name: origin recognition complex, subunit 4
  Uniprot ID: O43929
  ENSP ID: ENSP00000264169
MSSRKSKSNSLIHTECLSQVQRILRERFCRQSPHSNLFGVQVQYKHLSELLKRTALHGESNSVLIIGPRGSGKTMLINHALKELMEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGLSVLEICLIIAMKHLNDIYEEEPFNFQMVYNEFQKFVQRKAHSVYNFEKPVVMKAFEHLQQLELIKPMERTSGNSQREYQLMKLLLDNTQIMNALQKYPNCPTDVRQWATSSLSWL

SEQ ID NO: 60276 - protein, 436 aa, Homo sapiens; identical to SEQ ID NO: 60275
  Payload ID: 12065
  Gene Symbol: ORC4
  Gene Name: origin recognition complex, subunit 4
  Uniprot ID: O43929
  ENSP ID: ENSP00000376597

SEQ ID NO: 60277 - protein, 128 aa, Homo sapiens
  Payload ID: 12065
  Gene Symbol: ORC4
  Gene Name: origin recognition complex, subunit 4
  ENSP ID: ENSP00000391484
MSSRKSKSNSLIHTECLSQVQRILRERFCRQSPHSNLFGVQVQYKHLSELLKRTALHGESNSVLIIGPRGSGKTMLINHALKELMEIEEVSENVLQVHLNGLLQINDKIALKEITRQLNLENVVGDKV

SEQ ID NO: 60278 - protein, 127 aa, Homo sapiens
  Payload ID: 12065
  Gene Symbol: ORC4
  Gene Name: origin recognition complex, subunit 4
  ENSP ID: ENSP00000403105
MSSRKSKSNSLIHTECLSQVQRILRERFCRQSPHSNLFGVQVQYKHLSELLKRTALHGESNSVLIIGPRGSGKTMLINHALKELMEIEEVSENVLQVHLNGLLQINDKIALKEITRQLNLENVVGDK

SEQ ID NO: 60279 - protein, 145 aa, Homo sapiens
  Payload ID: 12065
  Gene Symbol: ORC4
  Gene Name: origin recognition complex, subunit 4
  ENSP ID: ENSP00000413939
MSSRKSKSNSLIHTECLSQVQRILRERFCRQSPHSNLFGVQVQYKHLSELLKRTALHGESNSVLIIGPRGSGKTMLINHALKELMEIEEVSENVLQVHLNGLLQINDKIALKEITRQLNLENVVGDKVFGSFAENLSFLLEALKK

SEQ ID NO: 60280 - protein, 362 aa, Homo sapiens
  Payload ID: 12065
  Gene Symbol: ORC4
  Gene Name: origin recognition complex, subunit 4
  Uniprot ID: O43929
  ENSP ID: ENSP00000438326
MLINHALKELMEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGLSVLEICLIIAMKHLNDIYEEEPFNFQMVYNEFQKFVQRKAHSVYNFEKPVVMKAFEHLQQLELIKPMERTSGNSQREYQLMKLLLDNTQIMNALQKYPNCPTDVRQWATSSLSWL

SEQ ID NO: 60281 - protein, 352 aa, Homo sapiens
  Payload ID: 12065
  Gene Symbol: ORC4
  Gene Name: origin recognition complex, subunit 4
  Uniprot ID: O43929
  ENSP ID: ENSP00000441502
MEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGLSVLEICLIIAMKHLNDIYEEEPFNFQMVYNEFQKFVQRKAHSVYNFEKPVVMKAFEHLQQLELIKPMERTSGNSQREYQLMKLLLDNTQIMNALQKYPNCPTDVRQWATSSLSWL

SEQ ID NO: 60282 - protein, 436 aa, Homo sapiens; identical to SEQ ID NO: 60275
  Payload ID: 12065
  Gene Symbol: ORC4
  Gene Name: origin recognition complex, subunit 4
  Uniprot ID: O43929
  ENSP ID: ENSP00000441953

SEQ ID NO: 60283 - protein, 435 aa, Homo sapiens
  Payload ID: 12066
  Gene Symbol: ORC5
  Gene Name: origin recognition complex, subunit 5
  Uniprot ID: O43913
  ENSP ID: ENSP00000297431
MPHLENVVLCRESQVSILQSLFGERHHFSFPSIFIYGHTASGKTYVTQTLLKTLELPHVFVNCVECFTLRLLLEQILNKLNHLSSSEDGCSTEITCETFNDFVRLFKQVTTAENLKDQTVYIVLDKAEYLRDMEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISSSQWEKLQKDDTDPGQLKGLSAHTHVELPYYSKFILIAAYLASYNPARTDKRFFLKHHGKIKKTNFLKKHEKTSNHLLGPKPFPLDRLLAILYSIVDSRVAPTANIFSQITSLVTLQLLTLVGHDDQLDGPKYKCTVSLDFIRAIARTVNFDIIKYLYDFL

SEQ ID NO: 60284 - protein, 66 aa, Homo sapiens
  Payload ID: 12066
  Gene Symbol: ORC5
  Gene Name: origin recognition complex, subunit 5
  ENSP ID: ENSP00000387465
MPHLENVVLCRESQVSILQSLFGERHHFSFPSIFIYGHTASGKTYVTQTLLKTLEGLRQALRICCL

SEQ ID NO: 60285 - protein, 66 aa, Homo sapiens; identical to SEQ ID NO: 60284
  Payload ID: 12066
  Gene Symbol: ORC5
  Gene Name: origin recognition complex, subunit 5
  ENSP ID: ENSP00000393208

SEQ ID NO: 60286 - protein, 324 aa, Homo sapiens
  Payload ID: 12066
  Gene Symbol: ORC5
  Gene Name: origin recognition complex, subunit 5
  Uniprot ID: O43913
  ENSP ID: ENSP00000395747
MPHLENVVLCRESQVSILQSLFGERHHFSFPSIFIYGHTASGKTYVTQTLLKTLELPHVFVNCVECFTLRLLLEQILNKLNHLSSSEDGCSTEITCETFNDFVRLFKQVTTAENLKDQTVYIVLDKAEYLRDMEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISSSQWEKLQKDDTDPGQLKGIRGSIETVTGDTSSANYQDTKVNTKEHSVRK

SEQ ID NO: 60287 - protein, 66 aa, Homo sapiens; identical to SEQ ID NO: 60284
  Payload ID: 12066
  Gene Symbol: ORC5
  Gene Name: origin recognition complex, subunit 5
  ENSP ID: ENSP00000486840

SEQ ID NO: 60288 - protein, 252 aa, Homo sapiens
  Payload ID: 12067
  Gene Symbol: ORC6
  Gene Name: origin recognition complex, subunit 6
  Uniprot ID: Q9Y5N6
  ENSP ID: ENSP00000219097
MGSELIGRLAPRLGLAEPDMLRKAEEYLRLSRVKCVGLSARTTETSSAVMCLDLAASWMKCPLDRAYLIKLSGLNKETYQSCLKSFECLLGLNSNIGIRDLAVQFSCIEAVNMASKILKSYESSLPQTQQVDLDLSRPLFTSAALLSACKILKLKVDKNKMVATSGVKKAIFDRLCKQLEKIGQQVDREPGDVATPPRKRKKIVVEAPAKEMEKVEEMPHKPQKDEDLTQDYEEWKRKILENAASAQKATAE

SEQ ID NO: 60289 - protein, 36 aa, Homo sapiens
  Payload ID: 12067
  Gene Symbol: ORC6
  Gene Name: origin recognition complex, subunit 6
  ENSP ID: ENSP00000454299
MGSELIGRLAPRLGLAEPDMLRPAVQSCAWTLQLPG

SEQ ID NO: 60290 - protein, 203 aa, Homo sapiens
  Payload ID: 12067
  Gene Symbol: ORC6
  Gene Name: origin recognition complex, subunit 6
  ENSP ID: ENSP00000456981
MCLDLAASWMKCPLDRAYLIKLSGLNKETYQSCLKSFECLLGLNSNIGIRDLAVQFSCIEAVNMASKILKSYESSLPQTQQVDLDLSRPLFTSAALLSACKILKLKVDKNKMVATSGVKKAIFDRLCKQLEKIGQQVDREPGDVATPPRKRKKIVVEAPAKEMEKVEEMPHKPQKDEDLTQDYEEWKRKILENAASAQKATAE

SEQ ID NO: 60291 - protein, 167 aa, Homo sapiens
  Payload ID: 12067
  Gene Symbol: ORC6
  Gene Name: origin recognition complex, subunit 6
  ENSP ID: ENSP00000457282
MGSELIGRLAPRLGLAEPDMLRKAEEYLRLSRVKCVGLSARTTETSSAVMCLDLAASWMKCPLDRAYLIKLSGLNKETYQSCLKSFECLLGLNSNIGIRDLAVQFSCIEAVNMASKILKSYESSLPQTQQVDLDLSRPLFTSAALLSACKRTWRCSYSTTEEKEDSG

SEQ ID NO: 60292 - protein, 153 aa, Homo sapiens
  Payload ID: 12068
  Gene Symbol: ORMDL1
  Gene Name: ORMDL sphingolipid biosynthesis regulator 1
  Uniprot ID: Q9P0S3
  ENSP ID: ENSP00000326869
MNVGVAHSEVNPNTRVMNSRGMWLTYALGVGLLHIVLLSIPFFSVPVAWTLTNIIHNLGMYVFLHAVKGTPFETPDQGKARLLTHWEQLDYGVQFTSSRKFFTISPIILYFLASFYTKYDPTHFILNTASLLSVLIPKMPQLHGVRIFGINKY

SEQ ID NO: 60293 - protein, 153 aa, Homo sapiens; identical to SEQ ID NO: 60292
  Payload ID: 12068
  Gene Symbol: ORMDL1
  Gene Name: ORMDL sphingolipid biosynthesis regulator 1
  Uniprot ID: Q9P0S3
  ENSP ID: ENSP00000376160

SEQ ID NO: 60294 - protein, 153 aa, Homo sapiens; identical to SEQ ID NO: 60292
  Payload ID: 12068
  Gene Symbol: ORMDL1
  Gene Name: ORMDL sphingolipid biosynthesis regulator 1
  Uniprot ID: Q9P0S3
  ENSP ID: ENSP00000376161

SEQ ID NO: 60295 - protein, 109 aa, Homo sapiens
  Payload ID: 12068
  Gene Symbol: ORMDL1
  Gene Name: ORMDL sphingolipid biosynthesis regulator 1
  ENSP ID: ENSP00000386253
MNVGVAHSEVNPNTRVMNSRGMWLTYALGVGLLHIVLLSIPFFSVPVAWTLTNIIHNLGMYVFLHAVKGTPFETPDQGKARLLTHWEQLDYGVQFTSSRKFFTISPIIL

SEQ ID NO: 60296 - protein, 108 aa, Homo sapiens
  Payload ID: 12068
  Gene Symbol: ORMDL1
  Gene Name: ORMDL sphingolipid biosynthesis regulator 1
  ENSP ID: ENSP00000402074
MNVGVAHSEVNPNTRVMNSRGMWLTYALGVGLLHIVLLSIPFFSVPVAWTLTNIIHNLGMYVFLHAVKGTPFETPDQGKARLLTHWEQLDYGVQFTSSRKFFTISPII

SEQ ID NO: 60297 - protein, 108 aa, Homo sapiens; identical to SEQ ID NO: 60296
  Payload ID: 12068
  Gene Symbol: ORMDL1
  Gene Name: ORMDL sphingolipid biosynthesis regulator 1
  ENSP ID: ENSP00000407234

SEQ ID NO: 60298 - protein, 153 aa, Homo sapiens
  Payload ID: 12069
  Gene Symbol: ORMDL2
  Gene Name: ORMDL sphingolipid biosynthesis regulator 2
  Uniprot ID: Q53FV1
  ENSP ID: ENSP00000243045
MNVGVAHSEVNPNTRVMNSRGIWLAYIILVGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 60299 - protein, 119 aa, Homo sapiens
  Payload ID: 12069
  Gene Symbol: ORMDL2
  Gene Name: ORMDL sphingolipid biosynthesis regulator 2
  ENSP ID: ENSP00000447834
MVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 60300 - protein, 153 aa, Homo sapiens; identical to SEQ ID NO: 60298
  Payload ID: 12069
  Gene Symbol: ORMDL2
  Gene Name: ORMDL sphingolipid biosynthesis regulator 2
  Uniprot ID: Q53FV1
  ENSP ID: ENSP00000448788

SEQ ID NO: 60301 - protein, 65 aa, Homo sapiens
  Payload ID: 12069
  Gene Symbol: ORMDL2
  Gene Name: ORMDL sphingolipid biosynthesis regulator 2
  ENSP ID: ENSP00000449461
MDYGLQFTSSRKFLSISPIVLYLLASFYTKYDAAHFLINTASLLSVLLPKLPQFHGVRVFGINKY

SEQ ID NO: 60302 - protein, 153 aa, Homo sapiens
  Payload ID: 12070
  Gene Symbol: ORMDL3
  Gene Name: ORMDL sphingolipid biosynthesis regulator 3
  Uniprot ID: Q8N138
  ENSP ID: ENSP00000304858
MNVGTAHSEVNPNTRVMNSRGIWLSYVLAIGLLHIVLLSIPFVSVPVVWTLTNLIHNMGMYIFLHTVKGTPFETPDQGKARLLTHWEQMDYGVQFTASRKFLTITPIVLYFLTSFYTKYDQIHFVLNTVSLMSVLIPKLPQLHGVRIFGINKY

SEQ ID NO: 60303 - protein, 153 aa, Homo sapiens; identical to SEQ ID NO: 60302
  Payload ID: 12070
  Gene Symbol: ORMDL3
  Gene Name: ORMDL sphingolipid biosynthesis regulator 3
  Uniprot ID: Q8N138
  ENSP ID: ENSP00000377724

SEQ ID NO: 60304 - protein, 102 aa, Homo sapiens
  Payload ID: 12070
  Gene Symbol: ORMDL3
  Gene Name: ORMDL sphingolipid biosynthesis regulator 3
  ENSP ID: ENSP00000462961
  MOD_RES (1)..(1): Any amino acid
XNLIHNMGMYIFLHTVKGTPFETPDQGKARLLTHWEQMDYGVQFTASRKFLTITPIVLYFLTSFYTKYDQIHFVLNTVSLMSVLIPKLPQLHGVRIFGINKY

SEQ ID NO: 60305 - protein, 129 aa, Homo sapiens
  Payload ID: 12070
  Gene Symbol: ORMDL3
  Gene Name: ORMDL sphingolipid biosynthesis regulator 3
  ENSP ID: ENSP00000464298
MNVGTAHSEVNPNTRVMNSRGIWLSYVLAIGLLHIVLLSIPFVSVPVVWTLTNLIHNMGMYIFLHTVKGTPFETPDQGKARLLTHWEQMDYGVQFTASRKFLTITPIVLYFLTSFYTKYDQIHFVLNTV

SEQ ID NO: 60306 - protein, 137 aa, Homo sapiens
  Payload ID: 12070
  Gene Symbol: ORMDL3
  Gene Name: ORMDL sphingolipid biosynthesis regulator 3
  Uniprot ID: Q8N138
  ENSP ID: ENSP00000464455
MNVGTAHSEVNPNTRVMNSRGIWLSYVLAIGLLHIVLLSIPFGMYIFLHTVKGTPFETPDQGKARLLTHWEQMDYGVQFTASRKFLTITPIVLYFLTSFYTKYDQIHFVLNTVSLMSVLIPKLPQLHGVRIFGINKY

SEQ ID NO: 60307 - protein, 153 aa, Homo sapiens; identical to SEQ ID NO: 60302
  Payload ID: 12070
  Gene Symbol: ORMDL3
  Gene Name: ORMDL sphingolipid biosynthesis regulator 3
  Uniprot ID: Q8N138
  ENSP ID: ENSP00000464693

SEQ ID NO: 60308 - protein, 439 aa, Homo sapiens
  Payload ID: 12071
  Gene Symbol: OAT
  Gene Name: ornithine aminotransferase
  Uniprot ID: P04181
  ENSP ID: ENSP00000357838
MFSKLAHLQRFAVLSRGVHSSVASATSVATKKTVQGPPTSDDIFEREYKYGAHNYHPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 60309 - protein, 301 aa, Homo sapiens
  Payload ID: 12071
  Gene Symbol: OAT
  Gene Name: ornithine aminotransferase
  Uniprot ID: P04181
  ENSP ID: ENSP00000439042
MNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 60310 - protein, 354 aa, Homo sapiens
  Payload ID: 12072
  Gene Symbol: OTC
  Gene Name: ornithine carbamoyltransferase
  Uniprot ID: P00480
  ENSP ID: ENSP00000039007
MLFNLRILLNNAAFRNGHNFMVRNFRCGQPLQNKVQLKGRDLLTLKNFTGEEIKYMLWLSADLKFRIKQKGEYLPLLQGKSLGMIFEKRSTRTRLSTETGFALLGGHPCFLTTQDIHLGVNESLTDTARVLSSMADAVLARVYKQSDLDTLAKEASIPIINGLSDLYHPIQILADYLTLQEHYSSLKGLTLSWIGDGNNILHSIMMSAAKFGMHLQAATPKGYEPDASVTKLAEQYAKENGTKLLLTNDPLEAAHGGNVLITDTWISMGQEEEKKKRLQAFQGYQVTMKTAKVAASDWTFLHCLPRKPEEVDDEVFYSPRSLVFPEAENRKWTIMAVMVSLLTDYSPQLQKPKF

SEQ ID NO: 60311 - protein, 461 aa, Homo sapiens
  Payload ID: 12073
  Gene Symbol: ODC1
  Gene Name: ornithine decarboxylase 1
  Uniprot ID: P11926
  ENSP ID: ENSP00000234111
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 60312 - protein, 461 aa, Homo sapiens; identical to SEQ ID NO: 60311
  Payload ID: 12073
  Gene Symbol: ODC1
  Gene Name: ornithine decarboxylase 1
  Uniprot ID: P11926
  ENSP ID: ENSP00000385333

SEQ ID NO: 60313 - protein, 68 aa, Homo sapiens
  Payload ID: 12073
  Gene Symbol: ODC1
  Gene Name: ornithine decarboxylase 1
  ENSP ID: ENSP00000390691
MNNFGNEEFDCHFLDEGFTAKDILDQKINEVSSSDDKDAFYVADLGDILKKHLRWLKALPRVTPFYAV

SEQ ID NO: 60314 - protein, 226 aa, Homo sapiens
  Payload ID: 12074
  Gene Symbol: OAZ1
  Gene Name: ornithine decarboxylase antizyme 1
  ENSP ID: ENSP00000463955
MVKSSLQRILNSHCFAREKEGDKPSATIHASRTMPLLSLHSRGGSSSERVSLHCCSNPGPGPRWCSDAPHPPLKIPGGRGNSQRDHNLSANLFYSDDRLNVTEELTSNDKTRILNVQSRLTDAKRINWRTVLSGGSLYIEIPGGALPEGSKDSFAVLLEFAEEQLRADHVFICFHKNREDRAALLRTFSFLGFEIVRPGHPLVPKRPDACFMAYTFERESSGEEEE

SEQ ID NO: 60315 - protein, 52 aa, Homo sapiens
  Payload ID: 12074
  Gene Symbol: OAZ1
  Gene Name: ornithine decarboxylase antizyme 1
  ENSP ID: ENSP00000467452
MVKSSLQRILNSHCFAREKEGDKPSATIHASRTMPLLSLHSRGGSSSERMIG

SEQ ID NO: 60316 - protein, 208 aa, Homo sapiens
  Payload ID: 12074
  Gene Symbol: OAZ1
  Gene Name: ornithine decarboxylase antizyme 1
  ENSP ID: ENSP00000468437
MARDAPGEAAHVDGTQGFSAGAAGELGVAHSDSPAAPWEDPRRFPGRRVPLPGARVPAAVVGEPAGSRSSFPDCVPRVPGSPSTAVVTRVRGLGGAPDAPHPPLKIPGGRGNSQRDHNLSANLFYSDDRLNVTEELTSNDKTRILNVQSRLTDAKRINWRTVLSGGSLYIEIPGGALPEGSKDSFAVLLEFAEEQLRADHVFICFHKN

SEQ ID NO: 60317 - protein, 228 aa, Homo sapiens
  Payload ID: 12074
  Gene Symbol: OAZ1
  Gene Name: ornithine decarboxylase antizyme 1
  Uniprot ID: P54368
  ENSP ID: ENSP00000473381
MVKSSLQRILNSHCFAREKEGDKPSATIHASRTMPLLSLHSRGGSSSESSRVSLHCCSNPGPGPRWCSDAPHPPLKIPGGRGNSQRDHNLSANLFYSDDRLNVTEELTSNDKTRILNVQSRLTDAKRINWRTVLSGGSLYIEIPGGALPEGSKDSFAVLLEFAEEQLRADHVFICFHKNREDRAALLRTFSFLGFEIVRPGHPLVPKRPDACFMAYTFERESSGEEEE

SEQ ID NO: 60318 - protein, 136 aa, Homo sapiens
  Payload ID: 12075
  Gene Symbol: OAZ2
  Gene Name: ornithine decarboxylase antizyme 2
  ENSP ID: ENSP00000462192
MINTQDSSILPLSNCPQLQCCRHIVPGPLWCSDAPHPLSKIPGGRGGGRDPSLSALIYKGRKRTWCWGKAWAFESGRPGFESHLCHSLSLEPWDEKLTVTQDLPVNDGKPHIVHFQYEVTEVKVSSWDAVLSSQSL

SEQ ID NO: 60319 - protein, 129 aa, Homo sapiens
  Payload ID: 12075
  Gene Symbol: OAZ2
  Gene Name: ornithine decarboxylase antizyme 2
  ENSP ID: ENSP00000462354
MINTQDSSILPLSNCPQLQCCRHIVPGPLWCSDAPHPLSKIPGGRGGGRDPSLSALIYKDEKLTVTQDLPVNDGKPHIVHFQYEVTEVKVSSWDAVLSSQSLFVEIPDGLLADGSKEGSTPEDLQLLGL

SEQ ID NO: 60320 - protein, 189 aa, Homo sapiens
  Payload ID: 12075
  Gene Symbol: OAZ2
  Gene Name: ornithine decarboxylase antizyme 2
  Uniprot ID: O95190
  ENSP ID: ENSP00000463013
MINTQDSSILPLSNCPQLQCCRHIVPGPLWCSDAPHPLSKIPGGRGGGRDPSLSALIYKDEKLTVTQDLPVNDGKPHIVHFQYEVTEVKVSSWDAVLSSQSLFVEIPDGLLADGSKEGLLALLEFAEEKMKVNYVFICFRKGREDRAPLLKTFSFLGFEIVRPGHPCVPSRPDVMFMVYPLDQNLSDED

SEQ ID NO: 60321 - protein, 60 aa, Homo sapiens
  Payload ID: 12075
  Gene Symbol: OAZ2
  Gene Name: ornithine decarboxylase antizyme 2
  ENSP ID: ENSP00000463729
MKVNYVFICFRKGREDRAPLLKTFSFLGFEIVRPGHPCVPSRPDVMFMVYPLDQNLSDED

SEQ ID NO: 60322 - protein, 190 aa, Homo sapiens
  Payload ID: 12076
  Gene Symbol: OAZ3
  Gene Name: ornithine decarboxylase antizyme 3
  ENSP ID: ENSP00000313922
MTVPWRPGKRRITYKEEEDLTLQPRSCLQCSESLVGLQEGKSTEQGNHDQLKELYSAGNLTVLATDPLLHQDPVQLDFHFRLTSQTSAHWHGLLCDRRLFLDIPYQALDQGNRESLTATLEYVEEKTNVDSVFVNFQNDRNDRGALLRAFSYMGFEVVRPDHPALPPLDNVIFMVYPLERDVGHLPSEPP

SEQ ID NO: 60323 - protein, 235 aa, Homo sapiens
  Payload ID: 12076
  Gene Symbol: OAZ3
  Gene Name: ornithine decarboxylase antizyme 3
  ENSP ID: ENSP00000383784
LPCKRCRPSVYSLSYIKRGKTRNYLYPIWSPYAYYLYCYKYRITLREKMLPRCYKSITYKEEEDLTLQPRSCLQCSESLVGLQEGKSTEQGNHDQLKELYSAGNLTVLATDPLLHQDPVQLDFHFRLTSQTSAHWHGLLCDRRLFLDIPYQALDQGNRESLTATLEYVEEKTNVDSVFVNFQNDRNDRGALLRAFSYMGFEVVRPDHPALPPLDNVIFMVYPLERDVGHLPSEPP

SEQ ID NO: 60324 - protein, 203 aa, Homo sapiens
  Payload ID: 12076
  Gene Symbol: OAZ3
  Gene Name: ornithine decarboxylase antizyme 3
  ENSP ID: ENSP00000415904
MRPEGGPRRRRQERPPPVLPAARRITYKEEEDLTLQPRSCLQCSESLVGLQEGKSTEQGNHDQLKELYSAGNLTVLATDPLLHQDPVQLDFHFRLTSQTSAHWHGLLCDRRLFLDIPYQALDQGNRESLTATLEYVEEKTNVDSVFVNFQNDRNDRGALLRAFSYMGFEVVRPDHPALPPLDNVIFMVYPLERDVGHLPSEPP

SEQ ID NO: 60325 - protein, 124 aa, Homo sapiens
  Payload ID: 12076
  Gene Symbol: OAZ3
  Gene Name: ornithine decarboxylase antizyme 3
  ENSP ID: ENSP00000463055
LPCKRCRPSVYSLSYIKRGKTRNYLYPIWSPYAYYLYCYKYRITLREKMLPRCYKSITYKEEEDLTLQPRSCLQCSESLVGLQEGKSTEQGNHDQLKELYSFDCNPGVRGREDKCGLCVCELPE

SEQ ID NO: 60326 - protein, 123 aa, Homo sapiens
  Payload ID: 12076
  Gene Symbol: OAZ3
  Gene Name: ornithine decarboxylase antizyme 3
  ENSP ID: ENSP00000463692
  MOD_RES (1)..(1): Any amino acid
XGKSTEQGNHDQLKELYSTSAHWHGLLCDRRLFLDIPYQALDQGNRESLTATLEYVEEKTNVDSVFVNFQNDRNDRGALLRAFSYMGFEVVRPDHPALPPLDNVIFMVYPLERDVGHLPSEPP

SEQ ID NO: 60327 - protein, 190 aa, Homo sapiens
  Payload ID: 12076
  Gene Symbol: OAZ3
  Gene Name: ornithine decarboxylase antizyme 3
  Uniprot ID: Q9UMX2
  ENSP ID: ENSP00000486158
MTVPWRPGKRRITYKEEEDLTLQPRPASSAPESLVGLQEGKSTEQGNHDQLKELYSAGNLTVLATDPLLHQDPVQLDFHFRLTSQTSAHWHGLLCDRRLFLDIPYQALDQGNRESLTATLEYVEEKTNVDSVFVNFQNDRNDRGALLRAFSYMGFEVVRPDHPALPPLDNVIFMVYPLERDVGHLPSEPP

SEQ ID NO: 60328 - protein, 79 aa, Homo sapiens
  Payload ID: 12076
  Gene Symbol: OAZ3
  Gene Name: ornithine decarboxylase antizyme 3
  ENSP ID: ENSP00000489350
MTVPWRPGKRRITYKEEEDLTLQPRSCLQCSESLVGLQEGKSTEQGNHDQLKELYSFDCNPGVRGREDKCGLCVCELPE

SEQ ID NO: 60329 - protein, 105 aa, Homo sapiens
  Payload ID: 12076
  Gene Symbol: OAZ3
  Gene Name: ornithine decarboxylase antizyme 3
  ENSP ID: ENSP00000489420
LQPRSCLQCSESLVGLQEGKSTEQGNHDQLKELYSAGNLTVLATDPLLHQDPVQLDFHFRLTSQTSAHWHGLLCDRRLFLDIPYQALDQGNRERCPAAGLQLHGL

SEQ ID NO: 60330 - protein, 231 aa, Homo sapiens
  Payload ID: 12077
  Gene Symbol: OFCC1
  Gene Name: orofacial cleft 1 candidate 1
  ENSP ID: ENSP00000325053
FRRDKFQQKALKQTKQKKSKSAEFLMVKEDREATEGTGNPAFNMSSPDLSACQTAEKKVIRHDMPDRTLAAHQQKFRLPASAEPKGNEYGRNYFDPLMDEEINPRQCATEVSREDDDRIFYNRLTKLFDESRQGEPQDESGREETLNSEAPGSSNKSHEIHKEASEATTAHLEEFQRSQKTIILLGSSPLEQEIRSTSLHCMEDEMSHPWILLLKVTAVIRSRRYYREQRF

SEQ ID NO: 60331 - protein, 122 aa, Homo sapiens
  Payload ID: 12077
  Gene Symbol: OFCC1
  Gene Name: orofacial cleft 1 candidate 1
  Uniprot ID: Q8IZS5
  ENSP ID: ENSP00000417429
TKQKKSKSAEFLMVKEDREATEGTGNPAFNMSSPDLSACQTAEKKVIRHDMPDRTLAAHQQKFRLPASAEPKGNEYGRNYFDPLMDEEINPRQCATEVSREGFEIRRGRPQRIHSYVTFKDW

SEQ ID NO: 60332 - protein, 4 aa, Homo sapiens
  Payload ID: 12077
  Gene Symbol: OFCC1
  Gene Name: orofacial cleft 1 candidate 1
  ENSP ID: ENSP00000417933
MERE

SEQ ID NO: 60333 - protein, 187 aa, Homo sapiens
  Payload ID: 12077
  Gene Symbol: OFCC1
  Gene Name: orofacial cleft 1 candidate 1
  ENSP ID: ENSP00000418013
  MOD_RES (1)..(1): Any amino acid
XSKSAEFLMVKEDREATEGTGNPAFNMSSPDLSACQTAEKKVIRHDMPDRTLAAHQQKFRLPASAEPKGNEYGRNYFDPLMDEEINPRQCATEVSREGAPSKEKWSIPKKIGPCSMDYDPNLLEEDDELHSQGDSLTDHSVKGKSTVWRIGEAEDYSQDISYLEELEEHRFSVCCSSVADSRYGDFF

SEQ ID NO: 60334 - protein, 208 aa, Homo sapiens
  Payload ID: 12077
  Gene Symbol: OFCC1
  Gene Name: orofacial cleft 1 candidate 1
  Uniprot ID: Q8IZS5
  ENSP ID: ENSP00000418251
MWITSLITMKDEDIFDLAGDPQDSLIPGPSPTPKQNPVCNEAFFGHQTFSLRETGLKSVHCQGQEAENMEREKFQQKALKQTKQKKSKSAEFLMVKEDREATEGTGNPAFNMSSPDLSACQTAEKKVIRHDMPDRTLAAHQQKFRLPASAEPKGNEYGRNYFDPLMDEEINPRQCATEVSREDESGREETLNSEAPGSSNKSHEIHKE

SEQ ID NO: 60335 - protein, 22 aa, Homo sapiens
  Payload ID: 12077
  Gene Symbol: OFCC1
  Gene Name: orofacial cleft 1 candidate 1
  ENSP ID: ENSP00000418286
MRETGLKSVHCQGQEAENMERE

SEQ ID NO: 60336 - protein, 106 aa, Homo sapiens
  Payload ID: 12077
  Gene Symbol: OFCC1
  Gene Name: orofacial cleft 1 candidate 1
  ENSP ID: ENSP00000418453
  MOD_RES (1)..(1): Any amino acid
XKQTKQKKSKSAEFLMVKEDREATEGTGNPAFNMSSPDLSACQTAEKKVIRHDMPDRTLAAHQQKFRLPASAEPKGNEYGRNYFDPLMDEEINPRQCATEVSREAF

SEQ ID NO: 60337 - protein, 300 aa, Homo sapiens
  Payload ID: 12077
  Gene Symbol: OFCC1
  Gene Name: orofacial cleft 1 candidate 1
  ENSP ID: ENSP00000419718
MEREKFQQKALKQTKQKKSKSAEFLMVKEDREATEGTGNPAFNMSSPDLSACQTAEKKVIRHDMPDRTLAAHQQKFRLPASAEPKGNEYGRNYFDPLMDEEINPRQCATEVSREVCLMAKGEKAESGVDNTAGLSEKETQKNPRAPMDEADVKSAAHSSQGSIPKKIGPCSMDYDPNLLEEDDELHSQGDSLTDHSVKGKSTVWRIGEAEDYSQDISYLEELEEHRFSVCCSSVADSRYGDFFKHLHFVLVSASSELQLSQWQSQGFWYIILLMFFLWFLRLYLHYLGQWLFLQAISTPV

SEQ ID NO: 60338 - protein, 218 aa, Homo sapiens
  Payload ID: 12077
  Gene Symbol: OFCC1
  Gene Name: orofacial cleft 1 candidate 1
  ENSP ID: ENSP00000419759
TKQKKSKSAEFLMVKEDREATEGTGNPAFNMSSPDLSACQTAEKKVIRHDMPDRTLAAHQQKFRLPASAEPKGNEYGRNYFDPLMDEEINPRQCATEVSREDDDRIFYNRLTKLFDESRQGEPQDESGREETLNSEAPGSSNKSHEIHKEASEATTAHLEEFQRSQKTIILLGSSPLEQEIRSTSLHCMEDEMSHPWILLLKVTAVIRSRRYYREQRF

SEQ ID NO: 60339 - protein, 118 aa, Homo sapiens
  Payload ID: 12077
  Gene Symbol: OFCC1
  Gene Name: orofacial cleft 1 candidate 1
  ENSP ID: ENSP00000420421
  MOD_RES (1)..(1): Any amino acid
XDDDRIFYNRLTKLFDESRQGEPQDESGREETLNSEAPGSSNKSHEIHKEASEATTAHLEEFQRSQKTIILLGSSPLEQEIRSTSLHCMEDEMSHPWILLLKVTAVIRSRRYYREQRF

SEQ ID NO: 60340 - protein, 311 aa, Homo sapiens
  Payload ID: 12077
  Gene Symbol: OFCC1
  Gene Name: orofacial cleft 1 candidate 1
  ENSP ID: ENSP00000473634
  MOD_RES (1)..(1): Any amino acid
XHCQGQEAENMEREKFQQKALKQTKQKKSKSAEFLMVKEDREATEGTGNPAFNMSSPDLSACQTAEKKVIRHDMPDRTLAAHQQKFRLPASAEPKGNEYGRNYFDPLMDEEINPRQCATEVSREDESGREETLNSEAPGSSNKSHEIHKEASEATTAHLEEFQRSQKTIILLGSSPLEQDLKFEGEGLNEYIPMSLLKTGKTFEKTPSQPFIADLNICKKDSAAQLGTLTEVTNDSKGAAGPRWKFLRNSRTPPFVENEQSQPPQPLQIQIRCLRGLKDKAPPGSYVLKVSKCPCLVDWEAVSCSGGKRSN

SEQ ID NO: 60341 - protein, 235 aa, Homo sapiens
  Payload ID: 12077
  Gene Symbol: OFCC1
  Gene Name: orofacial cleft 1 candidate 1
  ENSP ID: ENSP00000480108
MEREKFQQKALKQTKQKKSKSAEFLMVKEDREATEGTGNPAFNMSSPDLSACQTAEKKVIRHDMPDRTLAAHQQKFRLPASAEPKGTFTGNEYGRNYFDPLMDEEINPRQCATEVSREDDDRIFYNRLTKLFDESRQGEPQDESGREETLNSEAPGSSNKSHEIHKEASEATTAHLEEFQRSQKTIILLGSSPLEQEIRSTSLHCMEDEMSHPWILLLKVTAVIRSRRYYREQRF

SEQ ID NO: 60342 - protein, 235 aa, Homo sapiens
  Payload ID: 12077
  Gene Symbol: OFCC1
  Gene Name: orofacial cleft 1 candidate 1
  ENSP ID: ENSP00000484598
FRRDKFQQKALKQTKQKKSKSAEFLMVKEDREATEGTGNPAFNMSSPDLSACQTAEKKVIRHDMPDRTLAAHQQKFRLPASAEPKGTMPGNEYGRNYFDPLMDEEINPRQCATEVSREDDDRIFYNRLTKLFDESRQGEPQDESGREETLNSEAPGSSNKSHEIHKEASEATTAHLEEFQRSQKTIILLGSSPLEQEIRSTSLHCMEDEMSHPWILLLKVTAVIRSRRYYREQRF

SEQ ID NO: 60343 - protein, 201 aa, Homo sapiens
  Payload ID: 12078
  Gene Symbol: ORM1
  Gene Name: orosomucoid 1
  Uniprot ID: P02763
  ENSP ID: ENSP00000259396
MALSWVLTVLSLLPLLEAQIPLCANLVPVPITNATLDRITGKWFYIASAFRNEEYNKSVQEIQATFFYFTPNKTEDTIFLREYQTRQDQCIYNTTYLNVQRENGTISRYVGGQEHFAHLLILRDTKTYMLAFDVNDEKNWGLSVYADKPETTKEQLGEFYEALDCLRIPKSDVVYTDWKKDKCEPLEKQHEKERKQEEGES

SEQ ID NO: 60344 - protein, 201 aa, Homo sapiens
  Payload ID: 12079
  Gene Symbol: ORM2
  Gene Name: orosomucoid 2
  Uniprot ID: P19652
  ENSP ID: ENSP00000394936
MALSWVLTVLSLLPLLEAQIPLCANLVPVPITNATLDRITGKWFYIASAFRNEEYNKSVQEIQATFFYFTPNKTEDTIFLREYQTRQNQCFYNSSYLNVQRENGTVSRYEGGREHVAHLLFLRDTKTLMFGSYLDDEKNWGLSFYADKPETTKEQLGEFYEALDCLCIPRSDVMYTDWKKDKCEPLEKQHEKERKQEEGES

SEQ ID NO: 60345 - protein, 354 aa, Homo sapiens
  Payload ID: 12080
  Gene Symbol: OTX1
  Gene Name: orthodenticle homeobox 1
  Uniprot ID: P32242
  ENSP ID: ENSP00000282549
MMSYLKQPPYGMNGLGLAGPAMDLLHPSVGYPATPRKQRRERTTFTRSQLDVLEALFAKTRYPDIFMREEVALKINLPESRVQVWFKNRRAKCRQQQQSGSGTKSRPAKKKSSPVRESSGSESSGQFTPPAVSSSASSSSSASSSSANPAAAAAAGLGGNPVAAASSLSTPAASSIWSPASISPGSAPASVSVPEPLAAPSNTSCMQRSVAAGAATAAASYPMSYGQGGSYGQGYPTPSSSYFGGVDCSSYLAPMHSHHHPHQLSPMAPSSMAGHHHHHPHAHHPLSQSSGHHHHHHHHHHQGYGGSGLAFNSADCLDYKEPGAAAASSAWKLNFNSPDCLDYKDQASWRFQVL

SEQ ID NO: 60346 - protein, 354 aa, Homo sapiens; identical to SEQ ID NO: 60345
  Payload ID: 12080
  Gene Symbol: OTX1
  Gene Name: orthodenticle homeobox 1
  Uniprot ID: P32242
  ENSP ID: ENSP00000355631

SEQ ID NO: 60347 - protein, 101 aa, Homo sapiens
  Payload ID: 12080
  Gene Symbol: OTX1
  Gene Name: orthodenticle homeobox 1
  ENSP ID: ENSP00000385782
MMSYLKQPPYGMNGLGLAGPAMDLLHPSVGYPVRLSFAKAEIWACQGPARVLYRGSTWPPMTRGAPACPRSHSAEAAAGAHHLHAFTAGRARGALRQDSLP

SEQ ID NO: 60348 - protein, 297 aa, Homo sapiens
  Payload ID: 12081
  Gene Symbol: OTX2
  Gene Name: orthodenticle homeobox 2
  Uniprot ID: P32243
  ENSP ID: ENSP00000343819
MMSYLKQPPYAVNGLSLTTSGMDLLHPSVGYPGPWASCPAATPRKQRRERTTFTRAQLDVLEALFAKTRYPDIFMREEVALKINLPESRVQVWFKNRRAKCRQQQQQQQNGGQNKVRPAKKKTSPAREVSSESGTSGQFTPPSSTSVPTIASSSAPVSIWSPASISPLSDPLSTSSSCMQRSYPMTYTQASGYSQGYAGSTSYFGGMDCGSYLTPMHHQLPGPGATLSPMGTNAVTSHLNQSPASLSTQGYGASSLGFNSTTDCLDYKDQTASWKLNFNADCLDYKDQTSSWKFQVL

SEQ ID NO: 60349 - protein, 289 aa, Homo sapiens
  Payload ID: 12081
  Gene Symbol: OTX2
  Gene Name: orthodenticle homeobox 2
  Uniprot ID: P32243
  ENSP ID: ENSP00000386185
MMSYLKQPPYAVNGLSLTTSGMDLLHPSVGYPATPRKQRRERTTFTRAQLDVLEALFAKTRYPDIFMREEVALKINLPESRVQVWFKNRRAKCRQQQQQQQNGGQNKVRPAKKKTSPAREVSSESGTSGQFTPPSSTSVPTIASSSAPVSIWSPASISPLSDPLSTSSSCMQRSYPMTYTQASGYSQGYAGSTSYFGGMDCGSYLTPMHHQLPGPGATLSPMGTNAVTSHLNQSPASLSTQGYGASSLGFNSTTDCLDYKDQTASWKLNFNADCLDYKDQTSSWKFQVL

SEQ ID NO: 60350 - protein, 35 aa, Homo sapiens
  Payload ID: 12081
  Gene Symbol: OTX2
  Gene Name: orthodenticle homeobox 2
  ENSP ID: ENSP00000450468
MMSYLKQPPYAVNGLSLTTSGMDLLHPSVGYPGMV

SEQ ID NO: 60351 - protein, 163 aa, Homo sapiens
  Payload ID: 12081
  Gene Symbol: OTX2
  Gene Name: orthodenticle homeobox 2
  ENSP ID: ENSP00000451272
MMSYLKQPPYAVNGLSLTTSGMDLLHPSVGYPATPRKQRRERTTFTRAQLDVLEALFAKTRYPDIFMREEVALKINLPESRVQVWFKNRRAKCRQQQQQQQNGGQNKVRPAKKKTSPAREVSSESGTSGQFTPPSSTSVPTIASSSAPVSIWSPASISPLSDP

SEQ ID NO: 60352 - protein, 238 aa, Homo sapiens
  Payload ID: 12081
  Gene Symbol: OTX2
  Gene Name: orthodenticle homeobox 2
  ENSP ID: ENSP00000451357
MMSYLKQPPYAVNGLSLTTSGMDLLHPSVGYPGPWASCPAATPRKQRRERTTFTRAQLDVLEALFAKTRYPDIFMREEVALKINLPESRVQVWFKNRRAKCRQQQQQQQNGGQNKVRPAKKKTSPAREVSSESGTSGQFTPPSSTSVPTIASSSAPVSIWSPASISPLSDPLSTSSSCMQRSYPMTYTQASGYSQGYAGSTSYFGGMDCGSYLTPMHHQLPGPGATLSPMGTNAVTSH

SEQ ID NO: 60353 - protein, 289 aa, Homo sapiens; identical to SEQ ID NO: 60349
  Payload ID: 12081
  Gene Symbol: OTX2
  Gene Name: orthodenticle homeobox 2
  Uniprot ID: P32243
  ENSP ID: ENSP00000452336

SEQ ID NO: 60354 - protein, 35 aa, Homo sapiens; identical to SEQ ID NO: 60350
  Payload ID: 12081
  Gene Symbol: OTX2
  Gene Name: orthodenticle homeobox 2
  ENSP ID: ENSP00000474486

SEQ ID NO: 60355 - protein, 325 aa, Homo sapiens
  Payload ID: 12082
  Gene Symbol: OTP
  Gene Name: orthopedia homeobox
  Uniprot ID: Q5XKR4
  ENSP ID: ENSP00000302814
MLSHADLLDARLGMKDAAELLGHREAVKCRLGVGGSDPGGHPGDLAPNSDPVEGATLLPGEDITTVGSTPASLAVSAKDPDKQPGPQGGPNPSQAGQQQGQQKQKRHRTRFTPAQLNELERSFAKTHYPDIFMREELALRIGLTESRVQVWFQNRRAKWKKRKKTTNVFRAPGTLLPTPGLPQFPSAAAAAAAAMGDSLCSFHANDTRWAAAAMPGVSQLPLPPALGRQQAMAQSLSQCSLAAGPPPNSMGLSNSLAGSNGAGLQSHLYQPAFPGMVPASLPGPSNVSGSPQLCSSPDSSDVWRGTSIASLRRKALEHTVSMSFT

SEQ ID NO: 60356 - protein, 335 aa, Homo sapiens
  Payload ID: 12083
  Gene Symbol: OSGEP
  Gene Name: O-sialoglycoprotein endopeptidase
  Uniprot ID: Q9NPF4
  ENSP ID: ENSP00000206542
MPAVLGFEGSANKIGVGVVRDGKVLANPRRTYVTPPGTGFLPGDTARHHRAVILDLLQEALTESGLTSQDIDCIAYTKGPGMGAPLVSVAVVARTVAQLWNKPLVGVNHCIGHIEMGRLITGATSPTVLYVSGGNTQVIAYSEHRYRIFGETIDIAVGNCLDRFARVLKISNDPSPGYNIEQMAKRGKKLVELPYTVKGMDVSFSGILSFIEDVAHRMLATGECTPEDLCFSLQETVFAMLVEITERAMAHCGSQEALIVGGVGCNVRLQEMMATMCQERGARLFATDERFCIDNGAMIAQAGWEMFRAGHRTPLSDSGVTQRYRTDEVEVTWRD

SEQ ID NO: 60357 - protein, 111 aa, Homo sapiens
  Payload ID: 12083
  Gene Symbol: OSGEP
  Gene Name: O-sialoglycoprotein endopeptidase
  ENSP ID: ENSP00000450464
  MOD_RES (1)..(1): Any amino acid
XFLPGDTARHHRAVILDLLQEALTESGLTSQDIDCIAYTKGPGMGAPLVSVAVVARTVAQLWNKPLVGVNHCIGHIEMGRLITGATSPTVLYVSGGNTQTWGFMDFLITLR

SEQ ID NO: 60358 - protein, 149 aa, Homo sapiens
  Payload ID: 12083
  Gene Symbol: OSGEP
  Gene Name: O-sialoglycoprotein endopeptidase
  ENSP ID: ENSP00000451580
MPAVLGFEGSANKIGVGVVRDGKVLANPRRTYVTPPGTGFLPGDTARHHRAVILDLLQEALTESGLTSQDIDCIAYTKGPGMGAPLVSVAVVARTVAQLWNKPLVGVNHCIGHIEMGRLITGATSPTVLYVIAYSEHRYRIFGETIDIA

SEQ ID NO: 60359 - protein, 414 aa, Homo sapiens
  Payload ID: 12084
  Gene Symbol: OSGEPL1
  Gene Name: O-sialoglycoprotein endopeptidase-like 1
  Uniprot ID: Q9H4B0
  ENSP ID: ENSP00000264151
MLILTKTAGVFFKPSKRKVYEFLRSFNFHPGTLFLHKIVLGIETSCDDTAAAVVDETGNVLGEAIHSQTEVHLKTGGIVPPAAQQLHRENIQRIVQEALSASGVSPSDLSAIATTIKPGLALSLGVGLSFSLQLVGQLKKPFIPIHHMEAHALTIRLTNKVEFPFLVLLISGGHCLLALVQGVSDFLLLGKSLDIAPGDMLDKVARRLSLIKHPECSTMSGGKAIEHLAKQGNRFHFDIKPPLHHAKNCDFSFTGLQHVTDKIIMKKEKEEGIEKGQILSSAADIAATVQHTMACHLVKRTHRAILFCKQRDLLPQNNAVLVASGGVASNFYIRRALEILTNATQCTLLCPPPRLCTDNGIMIAWNGIERLRAGLGILHDIEGIRYEPKCPLGVDISKEVGEASIKVPQLKMEI

SEQ ID NO: 60360 - protein, 364 aa, Homo sapiens
  Payload ID: 12084
  Gene Symbol: OSGEPL1
  Gene Name: O-sialoglycoprotein endopeptidase-like 1
  Uniprot ID: Q9H4B0
  ENSP ID: ENSP00000428859
MLILTKTAGVFFKPSKRKVYEFLRSFNFHPGTLFLHKIVLGIETSCDDTAAAVVDETGNVLGEAIHSQTEVHLKTGGIVPPAAQQLHRENIQRIVQEALSASGVSPSDLSAIATTIKPGLALSLGVGLSFSLQLVGQLKKPFIPIHHMEAHALTIRLTNKVEFPFLVLLISGGHCLLALVQGVSDFLLLGKSLDIAPGDMLDKVARRLSLIKHPECSTMSGGKAIEHLAKQGNRFHFDIKPPLHHAKNCDFSFTGLQHVTDKIIMKKEKEEGIEKGQILSSAADIAATVQHTMACHLVKRTHRAILFCKQRDLLPQNNAVLVASGGVASNFYIRRALEILTNATQCTLLCPPPRLCTDNGIMIA

SEQ ID NO: 60361 - protein, 203 aa, Homo sapiens
  Payload ID: 12084
  Gene Symbol: OSGEPL1
  Gene Name: O-sialoglycoprotein endopeptidase-like 1
  ENSP ID: ENSP00000429385
MLILTKTAGVFFKPSKRKVYEFLRSFNFHPGTLFLHKIVLGIETSCDDTAAAVVDETGNVLGEAIHSQTEVHLKTGGIVPPAAQQLHRENIQRIVQEALSASGVSPSDLSAIATTIKPGLALSLGVGLSFSLQLVGQLKKPFIPIHHMEAHALTIRLTNKVEFPFLVLLISGGHCLLALVQGVSDFLLLGKSLDIAPGDMLDK

SEQ ID NO: 60362 - protein, 414 aa, Homo sapiens; identical to SEQ ID NO: 60359
  Payload ID: 12084
  Gene Symbol: OSGEPL1
  Gene Name: O-sialoglycoprotein endopeptidase-like 1
  Uniprot ID: Q9H4B0
  ENSP ID: ENSP00000429697

SEQ ID NO: 60363 - protein, 174 aa, Homo sapiens
  Payload ID: 12084
  Gene Symbol: OSGEPL1
  Gene Name: O-sialoglycoprotein endopeptidase-like 1
  ENSP ID: ENSP00000430062
MEAHALTIRLTNKVEFPFLVLLISGGHCLLALVQGVSDFLLLGKSLDIAPGDMLDKVARRLSLIKHPECSTMSGGKAIEHLAKQGNRFHFDIKPPLHHAKNCDFSFTGLQHVTDKIIMKKEKEEGIEKGQILSSAADIAATVQHTMACHLVKRTHRAILFCKQRDLLPQNNAVL

SEQ ID NO: 60364 - protein, 222 aa, Homo sapiens
  Payload ID: 12084
  Gene Symbol: OSGEPL1
  Gene Name: O-sialoglycoprotein endopeptidase-like 1
  ENSP ID: ENSP00000430879
MLILTKTAGVFFKPSKRKVYEFLRSFNFHPGTLFLHKIVLGIETSCDDTAAAVVDETGNVLGEAIHSQTEVHLKTGGIVPPAAQQLHRENIQRIVQEALSASGVSPSDLSAIATTIKPGLALSLGVGLSFSLQLVGQLKKPFIPIHHMEAHALTIRLTNKVEFPFLVLLISGGHCLLALVQGVSDFLLLGKSLDIAPGDMLDKVARRLSLIKHPECSTMSGG

SEQ ID NO: 60365 - protein, 252 aa, Homo sapiens
  Payload ID: 12085
  Gene Symbol: OSCAR
  Gene Name: osteoclast associated, immunoglobulin-like receptor
  ENSP ID: ENSP00000304523
MALVLILQLLTLFPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 60366 - protein, 267 aa, Homo sapiens
  Payload ID: 12085
  Gene Symbol: OSCAR
  Gene Name: osteoclast associated, immunoglobulin-like receptor
  ENSP ID: ENSP00000348927
MALVLILQLLTLWPLCHTDITPSVAIIVPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 60367 - protein, 263 aa, Homo sapiens
  Payload ID: 12085
  Gene Symbol: OSCAR
  Gene Name: osteoclast associated, immunoglobulin-like receptor
  ENSP ID: ENSP00000351145
MALVLILQLLTLWPLCHTDITPSVPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 60368 - protein, 286 aa, Homo sapiens
  Payload ID: 12085
  Gene Symbol: OSCAR
  Gene Name: osteoclast associated, immunoglobulin-like receptor
  ENSP ID: ENSP00000352671
MALVLILQLLTLWPLCHTDITPSVAIIVPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 60369 - protein, 282 aa, Homo sapiens
  Payload ID: 12085
  Gene Symbol: OSCAR
  Gene Name: osteoclast associated, immunoglobulin-like receptor
  Uniprot ID: Q8IYS5
  ENSP ID: ENSP00000365808
MALVLILQLLTLWPLCHTDITPSVPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 60370 - protein, 161 aa, Homo sapiens
  Payload ID: 12085
  Gene Symbol: OSCAR
  Gene Name: osteoclast associated, immunoglobulin-like receptor
  ENSP ID: ENSP00000375640
MALVLILQLLTLWPLCHTDITPSAGRILSGGGDSSPRGKLPLLLPKARLGAGCLVPAQRCPGAAGDRGAAAAVAGGAARAGGGSWRQREPALRGPPAEHELRAVPRGRGGPAAVPPLRAALGRLHAAGRPRPRHLQLLLSHALRALRAVAAQRGAGHQLGR

SEQ ID NO: 60371 - protein, 271 aa, Homo sapiens
  Payload ID: 12085
  Gene Symbol: OSCAR
  Gene Name: osteoclast associated, immunoglobulin-like receptor
  Uniprot ID: Q8IYS5
  ENSP ID: ENSP00000375641
MALVLILQLLTLFPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 60372 - protein, 271 aa, Homo sapiens
  Payload ID: 12085
  Gene Symbol: OSCAR
  Gene Name: osteoclast associated, immunoglobulin-like receptor
  Uniprot ID: Q8IYS5
  ENSP ID: ENSP00000477825
MALVLILQLLTLFPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 60373 - protein, 286 aa, Homo sapiens
  Payload ID: 12085
  Gene Symbol: OSCAR
  Gene Name: osteoclast associated, immunoglobulin-like receptor
  Uniprot ID: Q8IYS5
  ENSP ID: ENSP00000477845
MALVLILQLLTLWPLCHTDITPSVAIIVPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 60374 - protein, 267 aa, Homo sapiens
  Payload ID: 12085
  Gene Symbol: OSCAR
  Gene Name: osteoclast associated, immunoglobulin-like receptor
  ENSP ID: ENSP00000477994
MALVLILQLLTLWPLCHTDITPSVAIIVPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 60375 - protein, 267 aa, Homo sapiens; identical to SEQ ID NO: 60374
  Payload ID: 12085
  Gene Symbol: OSCAR
  Gene Name: osteoclast associated, immunoglobulin-like receptor
  ENSP ID: ENSP00000478027

SEQ ID NO: 60376 - protein, 271 aa, Homo sapiens; identical to SEQ ID NO: 60372
  Payload ID: 12085
  Gene Symbol: OSCAR
  Gene Name: osteoclast associated, immunoglobulin-like receptor
  Uniprot ID: Q8IYS5
  ENSP ID: ENSP00000478099

SEQ ID NO: 60377 - protein, 282 aa, Homo sapiens
  Payload ID: 12085
  Gene Symbol: OSCAR
  Gene Name: osteoclast associated, immunoglobulin-like receptor
  Uniprot ID: Q8IYS5
  ENSP ID: ENSP00000478216
MALVLILQLLTLWPLCHTDITPSVPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 60378 - protein, 286 aa, Homo sapiens; identical to SEQ ID NO: 60373
  Payload ID: 12085
  Gene Symbol: OSCAR
  Gene Name: osteoclast associated, immunoglobulin-like receptor
  ENSP ID: ENSP00000478224

SEQ ID NO: 60379 - protein, 268 aa, Homo sapiens
  Payload ID: 12085
  Gene Symbol: OSCAR
  Gene Name: osteoclast associated, immunoglobulin-like receptor
  ENSP ID: ENSP00000478230
MALVLILQLLTLWPLCHTDITPSAAPFIVPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 60380 - protein, 271 aa, Homo sapiens; identical to SEQ ID NO: 60372
  Payload ID: 12085
  Gene Symbol: OSCAR
  Gene Name: osteoclast associated, immunoglobulin-like receptor
  ENSP ID: ENSP00000478382

SEQ ID NO: 60381 - protein, 286 aa, Homo sapiens; identical to SEQ ID NO: 60373
  Payload ID: 12085
  Gene Symbol: OSCAR
  Gene Name: osteoclast associated, immunoglobulin-like receptor
  ENSP ID: ENSP00000478594

SEQ ID NO: 60382 - protein, 286 aa, Homo sapiens; identical to SEQ ID NO: 60368
  Payload ID: 12085
  Gene Symbol: OSCAR
  Gene Name: osteoclast associated, immunoglobulin-like receptor
  ENSP ID: ENSP00000479089

SEQ ID NO: 60383 - protein, 271 aa, Homo sapiens; identical to SEQ ID NO: 60372
  Payload ID: 12085
  Gene Symbol: OSCAR
  Gene Name: osteoclast associated, immunoglobulin-like receptor
  ENSP ID: ENSP00000479317

SEQ ID NO: 60384 - protein, 268 aa, Homo sapiens; identical to SEQ ID NO: 60379
  Payload ID: 12085
  Gene Symbol: OSCAR
  Gene Name: osteoclast associated, immunoglobulin-like receptor
  ENSP ID: ENSP00000479593

SEQ ID NO: 60385 - protein, 271 aa, Homo sapiens; identical to SEQ ID NO: 60371
  Payload ID: 12085
  Gene Symbol: OSCAR
  Gene Name: osteoclast associated, immunoglobulin-like receptor
  Uniprot ID: Q8IYS5
  ENSP ID: ENSP00000479628

SEQ ID NO: 60386 - protein, 268 aa, Homo sapiens; identical to SEQ ID NO: 60379
  Payload ID: 12085
  Gene Symbol: OSCAR
  Gene Name: osteoclast associated, immunoglobulin-like receptor
  ENSP ID: ENSP00000479650

SEQ ID NO: 60387 - protein, 286 aa, Homo sapiens; identical to SEQ ID NO: 60373
  Payload ID: 12085
  Gene Symbol: OSCAR
  Gene Name: osteoclast associated, immunoglobulin-like receptor
  Uniprot ID: Q8IYS5
  ENSP ID: ENSP00000479849

SEQ ID NO: 60388 - protein, 286 aa, Homo sapiens; identical to SEQ ID NO: 60373
  Payload ID: 12085
  Gene Symbol: OSCAR
  Gene Name: osteoclast associated, immunoglobulin-like receptor
  Uniprot ID: Q8IYS5
  ENSP ID: ENSP00000479954

SEQ ID NO: 60389 - protein, 282 aa, Homo sapiens; identical to SEQ ID NO: 60377
  Payload ID: 12085
  Gene Symbol: OSCAR
  Gene Name: osteoclast associated, immunoglobulin-like receptor
  Uniprot ID: Q8IYS5
  ENSP ID: ENSP00000480193

SEQ ID NO: 60390 - protein, 271 aa, Homo sapiens; identical to SEQ ID NO: 60372
  Payload ID: 12085
  Gene Symbol: OSCAR
  Gene Name: osteoclast associated, immunoglobulin-like receptor
  ENSP ID: ENSP00000480424

SEQ ID NO: 60391 - protein, 282 aa, Homo sapiens; identical to SEQ ID NO: 60377
  Payload ID: 12085
  Gene Symbol: OSCAR
  Gene Name: osteoclast associated, immunoglobulin-like receptor
  ENSP ID: ENSP00000480863

SEQ ID NO: 60392 - protein, 282 aa, Homo sapiens; identical to SEQ ID NO: 60377
  Payload ID: 12085
  Gene Symbol: OSCAR
  Gene Name: osteoclast associated, immunoglobulin-like receptor
  Uniprot ID: Q8IYS5
  ENSP ID: ENSP00000480900

SEQ ID NO: 60393 - protein, 268 aa, Homo sapiens; identical to SEQ ID NO: 60379
  Payload ID: 12085
  Gene Symbol: OSCAR
  Gene Name: osteoclast associated, immunoglobulin-like receptor
  ENSP ID: ENSP00000481050

SEQ ID NO: 60394 - protein, 267 aa, Homo sapiens; identical to SEQ ID NO: 60374
  Payload ID: 12085
  Gene Symbol: OSCAR
  Gene Name: osteoclast associated, immunoglobulin-like receptor
  Uniprot ID: Q8IYS5
  ENSP ID: ENSP00000481147

SEQ ID NO: 60395 - protein, 268 aa, Homo sapiens; identical to SEQ ID NO: 60379
  Payload ID: 12085
  Gene Symbol: OSCAR
  Gene Name: osteoclast associated, immunoglobulin-like receptor
  ENSP ID: ENSP00000481207

SEQ ID NO: 60396 - protein, 282 aa, Homo sapiens; identical to SEQ ID NO: 60377
  Payload ID: 12085
  Gene Symbol: OSCAR
  Gene Name: osteoclast associated, immunoglobulin-like receptor
  ENSP ID: ENSP00000481257

SEQ ID NO: 60397 - protein, 286 aa, Homo sapiens; identical to SEQ ID NO: 60373
  Payload ID: 12085
  Gene Symbol: OSCAR
  Gene Name: osteoclast associated, immunoglobulin-like receptor
  ENSP ID: ENSP00000481261

SEQ ID NO: 60398 - protein, 161 aa, Homo sapiens
  Payload ID: 12085
  Gene Symbol: OSCAR
  Gene Name: osteoclast associated, immunoglobulin-like receptor
  ENSP ID: ENSP00000481561
MALVLILQLLTLWPLCHTDITPSAGRILSGGGDSSPRGNLPLLLPKARLGAGCLVPAQRCPGAAGDRGAAAAVAGGAARAGGGSWRQREPALRGPPAEHELRAVPRGRGGPAAVPPLRAALGRLHAAGRPRPRHLQLLLSHALRALRAVAAQRGAGHQLGR

SEQ ID NO: 60399 - protein, 282 aa, Homo sapiens; identical to SEQ ID NO: 60377
  Payload ID: 12085
  Gene Symbol: OSCAR
  Gene Name: osteoclast associated, immunoglobulin-like receptor
  ENSP ID: ENSP00000481647

SEQ ID NO: 60400 - protein, 282 aa, Homo sapiens; identical to SEQ ID NO: 60377
  Payload ID: 12085
  Gene Symbol: OSCAR
  Gene Name: osteoclast associated, immunoglobulin-like receptor
  ENSP ID: ENSP00000481785

SEQ ID NO: 60401 - protein, 286 aa, Homo sapiens; identical to SEQ ID NO: 60373
  Payload ID: 12085
  Gene Symbol: OSCAR
  Gene Name: osteoclast associated, immunoglobulin-like receptor
  Uniprot ID: Q8IYS5
  ENSP ID: ENSP00000481805

SEQ ID NO: 60402 - protein, 267 aa, Homo sapiens; identical to SEQ ID NO: 60374
  Payload ID: 12085
  Gene Symbol: OSCAR
  Gene Name: osteoclast associated, immunoglobulin-like receptor
  Uniprot ID: Q8IYS5
  ENSP ID: ENSP00000481926

SEQ ID NO: 60403 - protein, 268 aa, Homo sapiens; identical to SEQ ID NO: 60379
  Payload ID: 12085
  Gene Symbol: OSCAR
  Gene Name: osteoclast associated, immunoglobulin-like receptor
  ENSP ID: ENSP00000482136

SEQ ID NO: 60404 - protein, 267 aa, Homo sapiens; identical to SEQ ID NO: 60374
  Payload ID: 12085
  Gene Symbol: OSCAR
  Gene Name: osteoclast associated, immunoglobulin-like receptor
  ENSP ID: ENSP00000482359

SEQ ID NO: 60405 - protein, 271 aa, Homo sapiens; identical to SEQ ID NO: 60372
  Payload ID: 12085
  Gene Symbol: OSCAR
  Gene Name: osteoclast associated, immunoglobulin-like receptor
  Uniprot ID: Q8IYS5
  ENSP ID: ENSP00000482402

SEQ ID NO: 60406 - protein, 282 aa, Homo sapiens; identical to SEQ ID NO: 60377
  Payload ID: 12085
  Gene Symbol: OSCAR
  Gene Name: osteoclast associated, immunoglobulin-like receptor
  ENSP ID: ENSP00000482414

SEQ ID NO: 60407 - protein, 268 aa, Homo sapiens; identical to SEQ ID NO: 60379
  Payload ID: 12085
  Gene Symbol: OSCAR
  Gene Name: osteoclast associated, immunoglobulin-like receptor
  ENSP ID: ENSP00000482428

SEQ ID NO: 60408 - protein, 271 aa, Homo sapiens; identical to SEQ ID NO: 60372
  Payload ID: 12085
  Gene Symbol: OSCAR
  Gene Name: osteoclast associated, immunoglobulin-like receptor
  ENSP ID: ENSP00000482460

SEQ ID NO: 60409 - protein, 267 aa, Homo sapiens; identical to SEQ ID NO: 60374
  Payload ID: 12085
  Gene Symbol: OSCAR
  Gene Name: osteoclast associated, immunoglobulin-like receptor
  ENSP ID: ENSP00000482545

SEQ ID NO: 60410 - protein, 286 aa, Homo sapiens; identical to SEQ ID NO: 60373
  Payload ID: 12085
  Gene Symbol: OSCAR
  Gene Name: osteoclast associated, immunoglobulin-like receptor
  ENSP ID: ENSP00000482610

SEQ ID NO: 60411 - protein, 286 aa, Homo sapiens; identical to SEQ ID NO: 60373
  Payload ID: 12085
  Gene Symbol: OSCAR
  Gene Name: osteoclast associated, immunoglobulin-like receptor
  ENSP ID: ENSP00000482734

SEQ ID NO: 60412 - protein, 267 aa, Homo sapiens; identical to SEQ ID NO: 60374
  Payload ID: 12085
  Gene Symbol: OSCAR
  Gene Name: osteoclast associated, immunoglobulin-like receptor
  Uniprot ID: Q8IYS5
  ENSP ID: ENSP00000482791

SEQ ID NO: 60413 - protein, 268 aa, Homo sapiens; identical to SEQ ID NO: 60379
  Payload ID: 12085
  Gene Symbol: OSCAR
  Gene Name: osteoclast associated, immunoglobulin-like receptor
  ENSP ID: ENSP00000482805

SEQ ID NO: 60414 - protein, 267 aa, Homo sapiens; identical to SEQ ID NO: 60374
  Payload ID: 12085
  Gene Symbol: OSCAR
  Gene Name: osteoclast associated, immunoglobulin-like receptor
  Uniprot ID: Q8IYS5
  ENSP ID: ENSP00000482997

SEQ ID NO: 60415 - protein, 267 aa, Homo sapiens; identical to SEQ ID NO: 60374
  Payload ID: 12085
  Gene Symbol: OSCAR
  Gene Name: osteoclast associated, immunoglobulin-like receptor
  ENSP ID: ENSP00000483090

SEQ ID NO: 60416 - protein, 268 aa, Homo sapiens [sequence omitted]

SEQ ID NO: 60417 - protein, 263 aa, Homo sapiens
  Payload ID: 12085
  Gene Symbol: OSCAR
  Gene Name: osteoclast associated, immunoglobulin-like receptor
  Uniprot ID: Q8IYS5
  ENSP ID: ENSP00000483744
MALVLILQLLTLWPLCHTDITPSVPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 60418 - protein, 271 aa, Homo sapiens; identical to SEQ ID NO: 60372
  Payload ID: 12085
  Gene Symbol: OSCAR
  Gene Name: osteoclast associated, immunoglobulin-like receptor
  Uniprot ID: Q8IYS5
  ENSP ID: ENSP00000484125

SEQ ID NO: 60419 - protein, 282 aa, Homo sapiens; identical to SEQ ID NO: 60377
  Payload ID: 12085
  Gene Symbol: OSCAR
  Gene Name: osteoclast associated, immunoglobulin-like receptor
  ENSP ID: ENSP00000484323

SEQ ID NO: 60420 - protein, 267 aa, Homo sapiens; identical to SEQ ID NO: 60366
  Payload ID: 12085
  Gene Symbol: OSCAR
  Gene Name: osteoclast associated, immunoglobulin-like receptor
  ENSP ID: ENSP00000484401

SEQ ID NO: 60421 - protein, 271 aa, Homo sapiens; identical to SEQ ID NO: 60372
  Payload ID: 12085
  Gene Symbol: OSCAR
  Gene Name: osteoclast associated, immunoglobulin-like receptor
  ENSP ID: ENSP00000484567

SEQ ID NO: 60422 - protein, 267 aa, Homo sapiens; identical to SEQ ID NO: 60374
  Payload ID: 12085
  Gene Symbol: OSCAR
  Gene Name: osteoclast associated, immunoglobulin-like receptor
  ENSP ID: ENSP00000484602

SEQ ID NO: 60423 - protein, 268 aa, Homo sapiens; identical to SEQ ID NO: 60379
  Payload ID: 12085
  Gene Symbol: OSCAR
  Gene Name: osteoclast associated, immunoglobulin-like receptor
  ENSP ID: ENSP00000484695

SEQ ID NO: 60424 - protein, 286 aa, Homo sapiens; identical to SEQ ID NO: 60373
  Payload ID: 12085
  Gene Symbol: OSCAR
  Gene Name: osteoclast associated, immunoglobulin-like receptor
  ENSP ID: ENSP00000484755

SEQ ID NO: 60425 - protein, 271 aa, Homo sapiens; identical to SEQ ID NO: 60372
  Payload ID: 12085
  Gene Symbol: OSCAR
  Gene Name: osteoclast associated, immunoglobulin-like receptor
  ENSP ID: ENSP00000484878

SEQ ID NO: 60426 - protein, 252 aa, Homo sapiens
  Payload ID: 12085
  Gene Symbol: OSCAR
  Gene Name: osteoclast associated, immunoglobulin-like receptor
  Uniprot ID: Q8IYS5
  ENSP ID: ENSP00000484977
MALVLILQLLTLFPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 60427 - protein, 214 aa, Homo sapiens
  Payload ID: 12086
  Gene Symbol: OSTF1
  Gene Name: osteoclast stimulating factor 1
  Uniprot ID: Q92882
  ENSP ID: ENSP00000340836
MSKPPPKPVKPGQVKVFRALYTFEPRTPDELYFEEGDIIYITDMSDTNWWKGTSKGRTGLIPSNYVAEQAESIDNPLHEAAKRGNLSWLRECLDNRVGVNGLDKAGSTALYWACHGGHKDIVEMLFTQPNIELNQQNKLGDTALHAAAWKGYADIVQLLLAKGARTDLRNIEKKLAFDMATNAACASLLKKKQGTDAVRTLSNAEDYLDDEDSD

SEQ ID NO: 60428 - protein, 566 aa, Homo sapiens
  Payload ID: 12087
  Gene Symbol: OCSTAMP
  Gene Name: osteoclast stimulatory transmembrane protein
  Uniprot ID: Q9BR26
  ENSP ID: ENSP00000279028
MPGHPGAAEQLVKTGWRSWHLGFWKALAPLQAAWDAFSQPVPASCGQLLTQLLLCASLAAAAAGLVYHWLASLLLYPPGPSAMVATVCGLLVFLSLGLVPPVRCLFALSVPTLGMEQGRRLLLSYSTATLAIAVVPNVLANVGAAGQVLRCVTEGSLESLLNTTHQLHAASRALGPTGQAGSRGLTFEAQDNGSAFYLHMLRVTQQVLEDFSGLESLARAAALGTQRVVTGLFMLGLLVESAWYLHCYLTDLRFDNIYATQQLTQRLAQAQATHLLAPPPTWLLQAAQLRLSQEELLSCLLRLGLLALLLVATAVAVATDHVAFLLAQATVDWAQKLPTVPITLTVKYDVAYTVLGFIPFLFNQLAPESPFLSVHSSYQWELRLTSARCPLLPARRPRAAAPLAAGALQLLAGSTVLLEAYARRLRHAIAASFFTAQEARRVRHLHARLQRRHDRHQGQQLPLGDPSCVPTPRPACKPPAWIDYRLDALRTESSEGEGKELWSCRDLSCNLGPVPPPCVTLGKSLHLSEPRFLHLHNDSIFTIDVTYFPRRDVVRMEGNTGHDRPG

SEQ ID NO: 60429 - protein, 133 aa, Homo sapiens
  Payload ID: 12088
  Gene Symbol: OSTN
  Gene Name: osteocrin
  Uniprot ID: P61366
  ENSP ID: ENSP00000342356
MLDWRLASAHFILAVTLTLWSSGKVLSVDVTTTEAFDSGVIDVQSTPTVREEKSATDLTAKLLLLDELVSLENDVIETKKKRSFSGFGSPLDRLSAGSVDHKGKQRKVVDHPKRRFGIPMDRIGRNRLSNSRG

SEQ ID NO: 60430 - protein, 111 aa, Homo sapiens
  Payload ID: 12088
  Gene Symbol: OSTN
  Gene Name: osteocrin
  ENSP ID: ENSP00000416576
MLDWRLASAHFILAVTLTLWSSGKVLSVDVTTTEAFDSGVIDVQSTPTVREEKSATDLTAKLLLLDELVSLENDVIETKKKRSFSGFGSPLDRLSAGSVDHKGKQRCNFLG

SEQ ID NO: 60431 - protein, 298 aa, Homo sapiens
  Payload ID: 12089
  Gene Symbol: OGN
  Gene Name: osteoglycin
  Uniprot ID: P20774
  ENSP ID: ENSP00000262551
MKTLQSTLLLLLLVPLIKPAPPTQQDSRIIYDYGTDNFEESIFSQDYEDKYLDGKNIKEKETVIIPNEKSLQLQKDEAITPLPPKKENDEMPTCLLCVCLSGSVYCEEVDIDAVPPLPKESAYLYARFNKIKKLTAKDFADIPNLRRLDFTGNLIEDIEDGTFSKLSLLEELSLAENQLLKLPVLPPKLTLFNAKYNKIKSRGIKANAFKKLNNLTFLYLDHNALESVPLNLPESLRVIHLQFNNIASITDDTFCKANDTSYIRDRIEEIRLEGNPIVLGKHPNSFICLKRLPIGSYF

SEQ ID NO: 60432 - protein, 298 aa, Homo sapiens; identical to SEQ ID NO: 60431
  Payload ID: 12089
  Gene Symbol: OGN
  Gene Name: osteoglycin
  Uniprot ID: P20774
  ENSP ID: ENSP00000364711

SEQ ID NO: 60433 - protein, 268 aa, Homo sapiens
  Payload ID: 12089
  Gene Symbol: OGN
  Gene Name: osteoglycin
  ENSP ID: ENSP00000396709
MLAKISTTWKLFLKLLGPEILLSSLKSRHSFSHSPSHLGLMHRHEHLLRKTTKNFKTATTTLQSTLLLLLLVPLIKPAPPTQQDSRIIYDYGTDNFEESIFSQDYEDKYLDGKNIKEKETVIIPNEKSLQLQKDEAITPLPPKKENDEMPTCLLCVCLSGSVYCEEVDIDAVPPLPKESAYLYARFNKIKKLTAKDFADIPNLRRLDFTGNLIEDIEDGTFSKLSLLEELSLAENQLLKLPVLPPKLTLFNAKYNKIKSRGIKANAFK

SEQ ID NO: 60434 - protein, 421 aa, Homo sapiens
  Payload ID: 12090
  Gene Symbol: OMD
  Gene Name: osteomodulin
  Uniprot ID: Q99983
  ENSP ID: ENSP00000364700
MGFLSPIYVIFFFFGVKVHCQYETYQWDEDYDQEPDDDYQTGFPFRQNVDYGVPFHQYTLGCVSECFCPTNFPSSMYCDNRKLKTIPNIPMHIQQLYLQFNEIEAVTANSFINATHLKEINLSHNKIKSQKIDYGVFAKLPNLLQLHLEHNNLEEFPFPLPKSLERLLLGYNEISKLQTNAMDGLVNLTMLDLCYNYLHDSLLKDKIFAKMEKLMQLNLCSNRLESMPPGLPSSLMYLSLENNSISSIPEKYFDKLPKLHTLRMSHNKLQDIPYNIFNLPNIVELSVGHNKLKQAFYIPRNLEHLYLQNNEIEKMNLTVMCPSIDPLHYHHLTYIRVDQNKLKEPISSYIFFCFPHIHTIYYGEQRSTNGQTIQLKTQVFRRFPDDDDESEDHDDPDNAHESPEQEGAEGHFDLHYYENQE

SEQ ID NO: 60435 - protein, 334 aa, Homo sapiens
  Payload ID: 12091
  Gene Symbol: OSTM1
  Gene Name: osteopetrosis associated transmembrane protein 1
  Uniprot ID: Q86WC4
  ENSP ID: ENSP00000193322
MEPGPTAAQRRCSLPPWLPLGLLLWSGLALGALPFGSSPHRVFHDLLSEQQLLEVEDLSLSLLQGGGLGPLSLPPDLPDLDPECRELLLDFANSSAELTGCLVRSARPVRLCQTCYPLFQQVVSKMDNISRAAGNTSESQSCARSLLMADRMQIVVILSEFFNTTWQEANCANCLTNNSEELSNSTVYFLNLFNHTLTCFEHNLQGNAHSLLQTKNYSEVCKNCREAYKTLSSLYSEMQKMNELENKAEPGTHLCIDVEDAMNITRKLWSRTFNCSVPCSDTVPVIAVSVFILFLPVVFYLSSFLHSEQKKRKLILPKRLKSSTSFANIQENSN

SEQ ID NO: 60436 - protein, 172 aa, Homo sapiens
  Payload ID: 12091
  Gene Symbol: OSTM1
  Gene Name: osteopetrosis associated transmembrane protein 1
  ENSP ID: ENSP00000398556
MADRMQIVVILSEFFNTTWQEANCANCLTNNSEELSNSTVYFLNLFNHTLTCFEHNLQGNAHSLLQTKNYSEVCKNCREAYKTLSSLYSEMQKMNELENKAEPGTHLCIDVEDAMNITRKLWSRTFNCSVPCSDTVPVIAVSVFILFLPVVFYLSSFLHSEQKKRKLILPKR

SEQ ID NO: 60437 - protein, 613 aa, Homo sapiens
  Payload ID: 12092
  Gene Symbol: OS9
  Gene Name: osteosarcoma amplified 9, endoplasmic reticulum lectin
  Uniprot ID: Q13438
  ENSP ID: ENSP00000257966
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQAVDSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 60438 - protein, 667 aa, Homo sapiens
  Payload ID: 12092
  Gene Symbol: OS9
  Gene Name: osteosarcoma amplified 9, endoplasmic reticulum lectin
  Uniprot ID: Q13438
  ENSP ID: ENSP00000318165
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 60439 - protein, 597 aa, Homo sapiens
  Payload ID: 12092
  Gene Symbol: OS9
  Gene Name: osteosarcoma amplified 9, endoplasmic reticulum lectin
  Uniprot ID: Q13438
  ENSP ID: ENSP00000373794
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 60440 - protein, 652 aa, Homo sapiens
  Payload ID: 12092
  Gene Symbol: OS9
  Gene Name: osteosarcoma amplified 9, endoplasmic reticulum lectin
  Uniprot ID: Q13438
  ENSP ID: ENSP00000373798
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 60441 - protein, 560 aa, Homo sapiens
  Payload ID: 12092
  Gene Symbol: OS9
  Gene Name: osteosarcoma amplified 9, endoplasmic reticulum lectin
  Uniprot ID: Q13438
  ENSP ID: ENSP00000389632
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 60442 - protein, 538 aa, Homo sapiens
  Payload ID: 12092
  Gene Symbol: OS9
  Gene Name: osteosarcoma amplified 9, endoplasmic reticulum lectin
  Uniprot ID: Q13438
  ENSP ID: ENSP00000407360
MAAETLLSSLLGLLLLGLLLPASLTGGVGSLNLEELSEMRYGIEILPLPVMGGQTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 60443 - protein, 406 aa, Homo sapiens
  Payload ID: 12092
  Gene Symbol: OS9
  Gene Name: osteosarcoma amplified 9, endoplasmic reticulum lectin
  ENSP ID: ENSP00000413112
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 60444 - protein, 186 aa, Homo sapiens
  Payload ID: 12092
  Gene Symbol: OS9
  Gene Name: osteosarcoma amplified 9, endoplasmic reticulum lectin
  ENSP ID: ENSP00000447031
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEGILLPSDRDRLRSEVKAGMERELENIIQETEKELDPDGLKKESERDRAMLAL

SEQ ID NO: 60445 - protein, 125 aa, Homo sapiens
  Payload ID: 12092
  Gene Symbol: OS9
  Gene Name: osteosarcoma amplified 9, endoplasmic reticulum lectin
  ENSP ID: ENSP00000447163
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKGGMERPQVENRL

SEQ ID NO: 60446 - protein, 146 aa, Homo sapiens
  Payload ID: 12092
  Gene Symbol: OS9
  Gene Name: osteosarcoma amplified 9, endoplasmic reticulum lectin
  ENSP ID: ENSP00000447451
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGLQAASS

SEQ ID NO: 60447 - protein, 162 aa, Homo sapiens
  Payload ID: 12092
  Gene Symbol: OS9
  Gene Name: osteosarcoma amplified 9, endoplasmic reticulum lectin
  ENSP ID: ENSP00000447719
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTYGNGSKCDLNGRPREAEVRFLCDEGAGISGDYIDRVDEPLSCSYVLTI

SEQ ID NO: 60448 - protein, 580 aa, Homo sapiens
  Payload ID: 12092
  Gene Symbol: OS9
  Gene Name: osteosarcoma amplified 9, endoplasmic reticulum lectin
  Uniprot ID: Q13438
  ENSP ID: ENSP00000447866
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKFLCDEGAGISGDYIDRVDEPLSCSYVLTIRTPRLCPHPLLRPPPSAAPQAILCHPSLQPEEYMAYVQRQAVDSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 60449 - protein, 75 aa, Homo sapiens
  Payload ID: 12092
  Gene Symbol: OS9
  Gene Name: osteosarcoma amplified 9, endoplasmic reticulum lectin
  ENSP ID: ENSP00000448478
MAAETLLSSLLGLLLLGLLLPASLTGGVGSLNLEELSEMRYGIEILPLPVMGGQPFFASLPPDPPFFPRANLRTW

SEQ ID NO: 60450 - protein, 75 aa, Homo sapiens; identical to SEQ ID NO: 60449
  Payload ID: 12092
  Gene Symbol: OS9
  Gene Name: osteosarcoma amplified 9, endoplasmic reticulum lectin
  ENSP ID: ENSP00000449789

SEQ ID NO: 60451 - protein, 612 aa, Homo sapiens
  Payload ID: 12092
  Gene Symbol: OS9
  Gene Name: osteosarcoma amplified 9, endoplasmic reticulum lectin
  Uniprot ID: Q13438
  ENSP ID: ENSP00000450010
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 60452 - protein, 1153 aa, Homo sapiens
  Payload ID: 12093
  Gene Symbol: OTOA
  Gene Name: otoancorin
  Uniprot ID: Q7RTW8
  ENSP ID: ENSP00000286149
MSQEPTTYSLFLFLFLSHGVSSYTVPNSRQDLHPLLQNMAEEIIDGSYLNALLDLIQFQSSHVWTDDLSHRVLAYLNSRNVAFTIPSLQAAVENHLEQRLHQPQKLLEDLRKTDAQQFRTAMKCLLEDKKDGLDLKDIIIDLGEIRERALQSPGVNRSLFLITLERCFQMLNSLECVEILGKVLRGSSGSFLQPDITERLPRDLREDAFKNLSAVFKDLYDKTSAHSQRALYSWMTGILQTSSNATDDSASWVSAEHLWVLGRYMVHLSFEEITKISPIEIGLFISYDNATKQLDMVYDITPELAQAFLERISSSNFNMRNTSTIHRQAHELWALEPFPKMLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 60453 - protein, 1060 aa, Homo sapiens
  Payload ID: 12093
  Gene Symbol: OTOA
  Gene Name: otoancorin
  Uniprot ID: Q7RTW8
  ENSP ID: ENSP00000373608
MGNSITYRDQAAVENHLEQRLHQPQKLLEDLRKTDAQQFRTAMKCLLEDKKDGLDLKDIIIDLGEIRERALQSPGVNRSLFLITLERCFQMLNSLECVEILGKVLRGSSGSFLQPDITERLPRDLREDAFKNLSAVFKDLYDKTSAHSQRALYSWMTGILQTSSNATDDSASWVSAEHLWVLGRYMVHLSFEEITKISPIEIGLFISYDNATKQLDMVYDITPELAQAFLERISSSNFNMRNTSTIHRLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 60454 - protein, 815 aa, Homo sapiens
  Payload ID: 12093
  Gene Symbol: OTOA
  Gene Name: otoancorin
  Uniprot ID: Q7RTW8
  ENSP ID: ENSP00000373609
MFRLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 60455 - protein, 1139 aa, Homo sapiens
  Payload ID: 12093
  Gene Symbol: OTOA
  Gene Name: otoancorin
  Uniprot ID: Q7RTW8
  ENSP ID: ENSP00000373610
MSQEPTTYSLFLFLFLSHGVSSYTVPNSRQDLHPLLQNMAEEIIDGSYLNALLDLIQFQSSHVWTDDLSHRVLAYLNSRNVAFTIPSLQAAVENHLEQRLHQPQKLLEDLRKTDAQQFRTAMKCLLEDKKDGLDLKDIIIDLGEIRERALQSPGVNRSLFLITLERCFQMLNSLECVEILGKVLRGSSGSFLQPDITERLPRDLREDAFKNLSAVFKDLYDKTSAHSQRALYSWMTGILQTSSNATDDSASWVSAEHLWVLGRYMVHLSFEEITKISPIEIGLFISYDNATKQLDMVYDITPELAQAFLERISSSNFNMRNTSTIHRLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 60456 - protein, 477 aa, Homo sapiens
  Payload ID: 12094
  Gene Symbol: OC90
  Gene Name: otoconin 90
  Uniprot ID: Q02509
  ENSP ID: ENSP00000254627
MIAFLLTSVLMIPHAGGHPLDTPHLPQELPPGLPNNINITFFSGMFKNVESVAEIFDCLGPHFTWLQAVFTNFPVLIQFVNGMKCVAGLCPRDFEDYGCTCRFEMEGLPVDESDSCCFQHRRCYEEAAEMDCLQDPAKLSTEVNCVSKKIICESKDNCEHLLCTCDKAAIECLARSSLNSSLNLLDTSFCLAQTPETTIKEDLTTLLPRVVPVEPTDTSLTALSGEEAGHDQEGVGAARATSPPGSAEIVATRVTAKIVTLVPAGIKSLGLAVSSVENDPEETTEKACDRFTFLHLGSGDNMQVMPQLGEMLFCLTSRCPEEFESYGCYCGQEGRGEPRDDLDRCCLSHHCCLEQVRRLGCLLERLPWSPVVCVDHTPKCGGQSLCEKLLCACDQTAAECMTSASFNQSLKSPSRLGCPGQPAACEDSLHPVPAAPTLGSSSEEDSEEDPPQEDLGRAKRFLRKSLGPLGIGPLHGR

SEQ ID NO: 60457 - protein, 1997 aa, Homo sapiens
  Payload ID: 12095
  Gene Symbol: OTOF
  Gene Name: otoferlin
  Uniprot ID: Q9HC10
  ENSP ID: ENSP00000272371
MALLIHLKTVSELRGRGDRIAKVTFRGQSFYSRVLENCEDVADFDETFRWPVASSIDRNEMLEIQVFNYSKVFSNKLIGTFRMVLQKVVEESHVEVTDTLIDDNNAIIKTSLCVEVRYQATDGTVGSWDDGDFLGDESLQEEEKDSQETDGLLPGSRPSSRPPGEKSFRRAGRSVFSAMKLGKNRSHKEEPQRPDEPAVLEMEDLDHLAIRLGDGLDPDSVSLASVTALTTNVSNKRSKPDIKMEPSAGRPMDYQVSITVIEARQLVGLNMDPVVCVEVGDDKKYTSMKESTNCPYYNEYFVFDFHVSPDVMFDKIIKISVIHSKNLLRSGTLVGSFKMDVGTVYSQPEHQFHHKWAILSDPDDISSGLKGYVKCDVAVVGKGDNIKTPHKANETDEDDIEGNLLLPEGVPPERQWARFYVKIYRAEGLPRMNTSLMANVKKAFIGENKDLVDPYVQVFFAGQKGKTSVQKSSYEPLWNEQVVFTDLFPPLCKRMKVQIRDSDKVNDVAIGTHFIDLRKISNDGDKGFLPTLGPAWVNMYGSTRNYTLLDEHQDLNEGLGEGVSFRARLLLGLAVEIVDTSNPELTSSTEVQVEQATPISESCAGKMEEFFLFGAFLEASMIDRRNGDKPITFEVTIGNYGNEVDGLSRPQRPRPRKEPGDEEEVDLIQNASDDEAGDAGDLASVSSTPPMRPQVTDRNYFHLPYLERKPCIYIKSWWPDQRRRLYNANIMDHIADKLEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 60458 - protein, 1230 aa, Homo sapiens
  Payload ID: 12095
  Gene Symbol: OTOF
  Gene Name: otoferlin
  Uniprot ID: Q9HC10
  ENSP ID: ENSP00000344521
MIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTAFVWFLNPLKSIKYLICTRYKWLIIKIVLALLGLLMLGLFLYSLPGYMVKKLLGA

SEQ ID NO: 60459 - protein, 1230 aa, Homo sapiens
  Payload ID: 12095
  Gene Symbol: OTOF
  Gene Name: otoferlin
  Uniprot ID: Q9HC10
  ENSP ID: ENSP00000345137
MIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 60460 - protein, 1307 aa, Homo sapiens
  Payload ID: 12095
  Gene Symbol: OTOF
  Gene Name: otoferlin
  Uniprot ID: Q9HC10
  ENSP ID: ENSP00000383906
MMTDTQDGPSESSQIMRSLTPLINREEAFGEAGEAGLWPSITHTPDSQEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 60461 - protein, 1997 aa, Homo sapiens
  Payload ID: 12095
  Gene Symbol: OTOF
  Gene Name: otoferlin
  Uniprot ID: Q9HC10
  ENSP ID: ENSP00000385255
MALLIHLKTVSELRGRGDRIAKVTFRGQSFYSRVLENCEDVADFDETFRWPVASSIDRNEMLEIQVFNYSKVFSNKLIGTFRMVLQKVVEESHVEVTDTLIDDNNAIIKTSLCVEVRYQATDGTVGSWDDGDFLGDESLQEEEKDSQETDGLLPGSRPSSRPPGEKSFRRAGRSVFSAMKLGKNRSHKEEPQRPDEPAVLEMEDLDHLAIRLGDGLDPDSVSLASVTALTTNVSNKRSKPDIKMEPSAGRPMDYQVSITVIEARQLVGLNMDPVVCVEVGDDKKYTSMKESTNCPYYNEYFVFDFHVSPDVMFDKIIKISVIHSKNLLRSGTLVGSFKMDVGTVYSQPEHQFHHKWAILSDPDDISSGLKGYVKCDVAVVGKGDNIKTPHKANETDEDDIEGNLLLPEGVPPERQWARFYVKIYRAEGLPRMNTSLMANVKKAFIGENKDLVDPYVQVFFAGQKGKTSVQKSSYEPLWNEQVVFTDLFPPLCKRMKVQIRDSDKVNDVAIGTHFIDLRKISNDGDKGFLPTLGPAWVNMYGSTRNYTLLDEHQDLNEGLGEGVSFRARLLLGLAVEIVDTSNPELTSSTEVQVEQATPISESCAGKMEEFFLFGAFLEASMIDRRNGDKPITFEVTIGNYGNEVDGLSRPQRPRPRKEPGDEEEVDLIQNASDDEAGDAGDLASVSSTPPMRPQVTDRNYFHLPYLERKPCIYIKSWWPDQRRRLYNANIMDHIADKLEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTAFVWFLNPLKSIKYLICTRYKWLIIKIVLALLGLLMLGLFLYSLPGYMVKKLLGA

SEQ ID NO: 60462 - protein, 141 aa, Homo sapiens
  Payload ID: 12095
  Gene Symbol: OTOF
  Gene Name: otoferlin
  ENSP ID: ENSP00000389917
  MOD_RES (1)..(1): Any amino acid
XKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTGEVVVTMEPEVPIKKLETMVKLDAVRRVGSAPCWLGTCNFV

SEQ ID NO: 60463 - protein, 1508 aa, Homo sapiens
  Payload ID: 12096
  Gene Symbol: OTOG
  Gene Name: otogelin
  Uniprot ID: Q6ZRI0
  ENSP ID: ENSP00000341666
MFPARGVPLHLEGEGVFPWGPGDVSLPYLSTSDVSFSVIVENVNCYSSGMICRKFISINVGNSLIVFDDDSGNPSPESFLDDKQEVHTWRVGFFTLVHFPQEHITLLWDQRTTVHVQAGPQWQGQLAGLCGNFDLKTINEMRTPENLELTNPQEFGSSWAAVECPDTLDPRDMCVLNPLREPFAKKECSILLSEVFEICHPVVDVTWFYSNCLTDTCGCSQGGDCECFCASVSAYAHQCCQHGVAVDWRTPRLCLLGKGPYQLSSLAAGGALVGMKAVGDDIVLVRTEDVAPADIVSFLLTAALYKAKAHDPDVVSLEAADRPNFFLHVTANGSLELAKWQGRDTFQQHASFLLHRGTRQAGLVALESLAKPSSFLYVSGAVLALRLYEHTEVFRRGTLFRLLDAKPSGAAYPICEWRYDACASPCFQTCRDPRAASCRDVPRVEGCVPVCPTPQVLDEVTQRCVYLEDCVEPAVWVPTEALGNETLPPSQGLPTPSDEEPQLSQESPRTPTHRPALTPAAPLTTALNPPVTATEEPVVSPGPTQTTLQQPLELTASQLPAGPTESPASKGVTASLLAIPHTPESSSLPVALQTPTPGMVSGAMETTRVTVIFAGSPNITVSSRSPPAPRFPLMTKAVTVRGHGSLPVRTTPPQPSLTASPSSRPVASPGAISRSPTSSGSHKAVLTPAVTKVISRTGVPQPTQAQSASSPSTPLTVAGTAAEQVPVSPLATRSLEIVLSTEKGEAGHSQPMGSPASPQPHPLPSAPPRPAQHTTMATRSPALPPETPAAASLSTATDGLAATPFMSLESTRPSQLLSGLPPDTSLPLAKVGTSAPVATPGPKASVITTPLQPQATTLPAQTLSPVLPFTPAAMTQAHPPTHIAPPAAGTAPGLLLGATLPTSGVLPVAEGTASMVSVVPRKSTTGKVAILSKQVSLPTSMYGSAEGGPTELTPATSHPLTPLVAEPEGAQAGTALPVPTSYALSRVSARTAPQDSMLVLLPQLAEAHGTSAGPHLAAEPVDEATTEPSGRSAPALSIVEGLAEALATTTEANTSTTCVPIAEQDCVRHICLEGQLIRVNQSQHCPQGAAPPRCGILGLAVRVGGDRCCPLWECACRCSIFPDLSFVTFDGSHVALFKEAIYILSQSPDEMLTVHVLDCKSANLGHLNWPPFCLVMLNMTHLAHQVTIDRFNRKVTVDLQPVWPPVSRYGFRIEDTGHMYMILTPSDIQIQWLHSSGLMIVEASKTSKAQGHGLCGICDGDAANDLTLKDGSVVGGAEDPAPFLDSWQVPSSLTSVGQTRFRPDSCATTDCSPCLRMVSNRTFSACHRFVPPESFCELWIRDTKYVQQPCVALTVYVAMCHKFHVCIEWRRSDYCPFLCSSDSTYQACVTACEPPKTCQDGILGPLDPEHCQVLGEGCVCSEGTILHRRHSALCIPEAKCACGDCPDSIPECQEGEALTVHRNTTELCCPLYQCVCENFRCPQVQCGLGTALVEVWSPDRCCPYKSCG

SEQ ID NO: 60464 - protein, 2925 aa, Homo sapiens
  Payload ID: 12096
  Gene Symbol: OTOG
  Gene Name: otogelin
  Uniprot ID: Q6ZRI0
  ENSP ID: ENSP00000382323
MGVLASALCWLLCVWLPWGEQAAESLRVQRLGERVVDSGRSGARGMRNVKGMRNGPAQTRVSSSSSHQEATLAMGDKATVVGGQQAEAPDSVAMSSWERRLHRAKCAPSYLFSCFNGGECVHPAFCDCRRFNATGPRCQMVYNAGPERDSICRAWGQHHVETFDGLYYYLSGKGSYTLVGRHEPEGQSFSIQVHNDPQCGSSPYTCSRAVSLFFVGEQEIHLAKEVTHGGMRVQLPHVMGSARLQQLAGYVIVRHQSAFTLAWDGASAVYIKMSPELLGWTHGLCGNNNADPKDDLVTSSGKLTDDVVEFVHSWQEQAPNQPPGPTTSSLPRPPCLQQNPGTMQGVYEQCEALLRPPFDACHAYVSPLPFTASCTSDLCQSMGDVATWCRALAEYARACAQAGRPLQGWRTQLRQCTVHCKEKAFTYNECIACCPASCHPRASCVDSEIACVDGCYCPNGLIFEDGGCVAPAECPCEFHGTLYPPGSVVKEDCNTCTCTSGKWECSTAVCPAECSVTGDIHFTTFDGRRYTFPATCQYILAKSRSSGTFTVTLQNAPCGLNQDGACVQSVSVILHQDPRRQVTLTQAGDVLLFDQYKIIPPYTDDAFEIRRLSSVFLRVRTNVGVRVLYDREGLRLYLQVDQRWVEDTVGLCGTFNGNTQDDFLSPVGVPESTPQLFGNSWKTLSACSPLVSGSPLDPCDVHLQAASYSVQACSVLTGEMFAPCSAFLSPVPYFEQCRRDACRCGQPCLCATLAHYAHLCRRHGLPVDFRARLPACALSCEASKEYSPCVAPCGRTCQDLASPEACGVDGGDDLSRDECVEGCACPPDTYLDTQADLCVPRNQCSCHFQGVDYPPGDSDIPSLGHCHCKDGVMSCDSRAPAAACPAGQVFVNCSDLHTDLELSRERTCEQQLLNLSVSARGPCLSGCACPQGLLRHGDACFLPEECPCTWKGKEYFPGDQVMSPCHTCVCQRGSFQCTLHPCASTCTAYGDRHYRTFDGLPFDFVGACKVHLVKSTSDVSFSVIVENVNCYSSGMICRKFISINVGNSLIVFDDDSGNPSPESFLDDKQEVHTWRVGFFTLVHFPQEHITLLWDQRTTVHVQAGPQWQGQLAGLCGNFDLKTINEMRTPENLELTNPQEFGSSWAAVECPDTLDPRDMCVLNPLREPFAKKECSILLSEVFEICHPVVDVTWFYSNCLTDTCGCSQGGDCECFCASVSAYAHQCCQHGVAVDWRTPRLCPYDCDFFNKVLGKGPYQLSSLAAGGALVGMKAVGDDIVLVRTEDVAPADIVSFLLTAALYKAKAHDPDVVSLEAADRPNFFLHVTANGSLELAKWQGRDTFQQHASFLLHRGTRQAGLVALESLAKPSSFLYVSGAVLALRLYEHTEVFRRGTLFRLLDAKPSGAAYPICEWRYDACASPCFQTCRDPRAASCRDVPRVEGCVPVCPTPQVLDEVTQRCVYLEDCVEPAVWVPTEALGNETLPPSQGLPTPSDEEPQLSQESPRTPTHRPALTPAAPLTTALNPPVTATEEPVVSPGPTQTTLQQPLELTASQLPAGPTESPASKGVTASLLAIPHTPESSSLPVALQTPTPGMVSGAMETTRVTVIFAGSPNITVSSRSPPAPRFPLMTKAVTVRGHGSLPVRTTPPQPSLTASPSSRPVASPGAISRSPTSSGSHKAVLTPAVTKVISRTGVPQPTQAQSASSPSTPLTVAGTAAEQVPVSPLATRSLEIVLSTEKGEAGHSQPMGSPASPQPHPLPSAPPRPAQHTTMATRSPALPPETPAAASLSTATDGLAATPFMSLESTRPSQLLSGLPPDTSLPLAKVGTSAPVATPGPKASVITTPLQPQATTLPAQTLSPVLPFTPAAMTQAHPPTHIAPPAAGTAPGLLLGATLPTSGVLPVAEGTASMVSVVPRKSTTGKVAILSKQVSLPTSMYGSAEGGPTELTPATSHPLTPLVAEPEGAQAGTALPVPTSYALSRVSARTAPQDSMLVLLPQLAEAHGTSAGPHLAAEPVDEATTEPSGRSAPALSIVEGLAEALATTTEANTSTTCVPIAEQDCVRHICLEGQLIRVNQSQHCPQGAAPPRCGILGLAVRVGGDRCCPLWECACRCSIFPDLSFVTFDGSHVALFKEAIYILSQSPDEMLTVHVLDCKSANLGHLNWPPFCLVMLNMTHLAHQVTIDRFNRKVTVDLQPVWPPVSRYGFRIEDTGHMYMILTPSDIQIQWLHSSGLMIVEASKTSKAQGHGLCGICDGDAANDLTLKDGSVVGGAEDPAPFLDSWQVPSSLTSVGQTRFRPDSCATTDCSPCLRMVSNRTFSACHRFVPPESFCELWIRDTKYVQQPCVALTVYVAMCHKFHVCIEWRRSDYCPFLCSSDSTYQACVTACEPPKTCQDGILGPLDPEHCQVLGEGCVCSEGTILHRRHSALCIPEAKCACTDSMGVPRALGETWNSSLSGCCQHQCQAPDTIVPVDLGCPSPRPESCLRFGEVALLLPTKDPCCLGTVCVCNQTLCEGLAPTCRPGHRLLTHFQEDSCCPSYSCECDPDLCEAELVPSCRQDQILITGRLGDSCCTSYFCACGDCPDSIPECQEGEALTVHRNTTELCCPLYQCVCENFRCPQVQCGLGTALVEVWSPDRCCPYKSCECDCDTIPVPRCHLWEKSQLDEEFMHSVENVCGCAKYECVKAPVCLSRELGVMQPGQTVVELSADGVCHTSRCTTVLDPLTNFYQINTTSVLCDIHCEANQEYEHPRDLAACCGSCRNVSCLFTFPNGTTSLFLPGASWIADCARHHCSSTPLGAVLVRSPISCPPLNETECAKVGGSVVPSLEGCCRTCKEDGRSCKKVTIRMTIRKNECRSSTPVNLVSCDGRCPSASIYNYNINTYARFCKCCREVGLQRRSVQLFCATNATWVPYTVQEPTDCACQWS

SEQ ID NO: 60465 - protein, 2913 aa, Homo sapiens
  Payload ID: 12096
  Gene Symbol: OTOG
  Gene Name: otogelin
  ENSP ID: ENSP00000382329
MGVLASALCWLLCVWLPWGEQAAESLRVQRLAAAPVLWGSAEPQPEPAGQPSSSHQEATLAMGDKATVVGGQQAEAPDSVAMSSWERRLHRAKCAPSYLFSCFNGGECVHPAFCDCRRFNATGPRCQMVYNAGPERDSICRAWGQHHVETFDGLYYYLSGKGSYTLVGRHEPEGQSFSIQVHNDPQCGSSPYTCSRAVSLFFVGEQEIHLAKEVTHGGMRVQLPHVMGSARLQQLAGYVIVRHQSAFTLAWDGASAVYIKMSPELLGWTHGLCGNNNADPKDDLVTSSGKLTDDVVEFVHSWQEQAPNQPPGPTTSSLPRPPCLQQNPGTMQGVYEQCEALLRPPFDACHAYVSPLPFTASCTSDLCQSMGDVATWCRALAEYARACAQAGRPLQGWRTQLRQCTVHCKEKAFTYNECIACCPASCHPRASCVDSEIACVDGCYCPNGLIFEDGGCVAPAECPCEFHGTLYPPGSVVKEDCNTCTCTSGKWECSTAVCPAECSVTGDIHFTTFDGRRYTFPATCQYILAKSRSSGTFTVTLQNAPCGLNQDGACVQSVSVILHQDPRRQVTLTQAGDVLLFDQYKIIPPYTDDAFEIRRLSSVFLRVRTNVGVRVLYDREGLRLYLQVDQRWVEDTVGLCGTFNGNTQDDFLSPVGVPESTPQLFGNSWKTLSACSPLVSGSPLDPCDVHLQAASYSVQACSVLTGEMFAPCSAFLSPVPYFEQCRRDACRCGQPCLCATLAHYAHLCRRHGLPVDFRARLPACALSCEASKEYSPCVAPCGRTCQDLASPEACGVDGGDDLSRDECVEGCACPPDTYLDTQADLCVPRNQCSCHFQGVDYPPGDSDIPSLGHCHCKDGVMSCDSRAPAAACPAGQVFVNCSDLHTDLELSRERTCEQQLLNLSVSARGPCLSGCACPQGLLRHGDACFLPEECPCTWKGKEYFPGDQVMSPCHTCVCQRGSFQCTLHPCASTCTAYGDRHYRTFDGLPFDFVGACKVHLVKSTSDVSFSVIVENVNCYSSGMICRKFISINVGNSLIVFDDDSGNPSPESFLDDKQEVHTWRVGFFTLVHFPQEHITLLWDQRTTVHVQAGPQWQGQLAGLCGNFDLKTINEMRTPENLELTNPQEFGSSWAAVECPDTLDPRDMCVLNPLREPFAKKECSILLSEVFEICHPVVDVTWFYSNCLTDTCGCSQGGDCECFCASVSAYAHQCCQHGVAVDWRTPRLCPYDCDFFNKVLGKGPYQLSSLAAGGALVGMKAVGDDIVLVRTEDVAPADIVSFLLTAALYKAKAHDPDVVSLEAADRPNFFLHVTANGSLELAKWQGRDTFQQHASFLLHRGTRQAGLVALESLAKPSSFLYVSGAVLALRLYEHTEVFRRGTLFRLLDAKPSGAAYPICEWRYDACASPCFQTCRDPRAASCRDVPRVEGCVPVCPTPQVLDEVTQRCVYLEDCVEPAVWVPTEALGNETLPPSQGLPTPSDEEPQLSQESPRTPTHRPALTPAAPLTTALNPPVTATEEPVVSPGPTQTTLQQPLELTASQLPAGPTESPASKGVTASLLAIPHTPESSSLPVALQTPTPGMVSGAMETTRVTVIFAGSPNITVSSRSPPAPRFPLMTKAVTVRGHGSLPVRTTPPQPSLTASPSSRPVASPGAISRSPTSSGSHKAVLTPAVTKVISRTGVPQPTQAQSASSPSTPLTVAGTAAEQVPVSPLATRSLEIVLSTEKGEAGHSQPMGSPASPQPHPLPSAPPRPAQHTTMATRSPALPPETPAAASLSTATDGLAATPFMSLESTRPSQLLSGLPPDTSLPLAKVGTSAPVATPGPKASVITTPLQPQATTLPAQTLSPVLPFTPAAMTQAHPPTHIAPPAAGTAPGLLLGATLPTSGVLPVAEGTASMVSVVPRKSTTGKVAILSKQVSLPTSMYGSAEGGPTELTPATSHPLTPLVAEPEGAQAGTALPVPTSYALSRVSARTAPQDSMLVLLPQLAEAHGTSAGPHLAAEPVDEATTEPSGRSAPALSIVEGLAEALATTTEANTSTTCVPIAEQDCVRHICLEGQLIRVNQSQHCPQGAAPPRCGILGLAVRVGGDRCCPLWECACRCSIFPDLSFVTFDGSHVALFKEAIYILSQSPDEMLTVHVLDCKSANLGHLNWPPFCLVMLNMTHLAHQVTIDRFNRKVTVDLQPVWPPVSRYGFRIEDTGHMYMILTPSDIQIQWLHSSGLMIVEASKTSKAQGHGLCGICDGDAANDLTLKDGSVVGGAEDPAPFLDSWQVPSSLTSVGQTRFRPDSCATTDCSPCLRMVSNRTFSACHRFVPPESFCELWIRDTKYVQQPCVALTVYVAMCHKFHVCIEWRRSDYCPFLCSSDSTYQACVTACEPPKTCQDGILGPLDPEHCQVLGEGCVCSEGTILHRRHSALCIPEAKCACTDSMGVPRALGETWNSSLSGCCQHQCQAPDTIVPVDLGCPSPRPESCLRFGEVALLLPTKDPCCLGTVCVCNQTLCEGLAPTCRPGHRLLTHFQEDSCCPSYSCECDPDLCEAELVPSCRQDQILITGRLGDSCCTSYFCACGDCPDSIPECQEGEALTVHRNTTELCCPLYQCVCENFRCPQVQCGLGTALVEVWSPDRCCPYKSCECDCDTIPVPRCHLWEKSQLDEEFMHSVENVCGCAKYECVKAPVCLSRELGVMQPGQTVVELSADGVCHTSRCTTVLDPLTNFYQINTTSVLCDIHCEANQEYEHPRDLAACCGSCRNVSCLFTFPNGTTSLFLPGASWIADCARHHCSSTPLGAVLVRSPISCPPLNETECAKVGGSVVPSLEGCCRTCKEDGRSCKKVTIRMTIRKNECRSSTPVNLVSCDGRCPSASIYNYNINTYARFCKCCREVGLQRRSVQLFCATNATWVPYTVQEPTDCACQWS

SEQ ID NO: 60466 - protein, 94 aa, Homo sapiens
  Payload ID: 12096
  Gene Symbol: OTOG
  Gene Name: otogelin
  ENSP ID: ENSP00000399057
AMGDKATVVGGQAEAPDSVAMSSWERRLHRAKCAPSYLFSCFNGGECVHPAFCDCRRFNATGPRCQMVYNAGPERDSICRAWGQHHVETFDGLY

SEQ ID NO: 60467 - protein, 752 aa, Homo sapiens
  Payload ID: 12097
  Gene Symbol: OTOGL
  Gene Name: otogelin-like
  ENSP ID: ENSP00000298820
  MOD_RES (1)..(1): Any amino acid
XEIIVAHIEKCSMNQNGNSLKKLAPSGRISGLCFKKLNVTTPIHKIIVNRLARKVEVDSIVVPLPFSSQELSIEDSGSMYVITTPAGLIIKWSHLTGIIDIHFGFRFNLSSYTEGLCGICNEDPDDDLRMQNGTIITNMEDIGLFIESWEIEKSFEVTMRRPVRNCTEHDCSQCIDLLNRRIFIPCHDKVSPEDFCEKMWINYTYFWNYECDALSAYVALCNKFDICIQWRTPDYCSLSCPEGKEYQPCVRPCEARTCLNQWFYGHTSCLNLREDCVCKVGTILHRPHSAQCIPEKECACTDSEDQPRTAGEIWNGGIDECTLYKCLENGSIIPIEPDCDEEPTPVCEREAEVVMGIIDKWTCCSKEVCGCDTTLCETSIPTCTNSQKLIVGHSPLSCCPQYKCECDPLKCPSISTPECREDQFMIQVRQEEPCCFSPFCVCESCTKPVPLCHDGEFLTVDLNSTHFCCPQYYCVCEPNLCPMPLLNCAEDMNLVKENVSGQCCPTWHCEKDDVCVFQEVSVLNPGQSMIKYLEEDFCYAIECLEEKDNHTGFHTLNFTLVNCSKKCDVHQVYTPSPSDYGCCGTCKNVSCKFHMENGTSVVYAVGSTWHYNCTTYECVKTDEGAIILNYTMVCPPFNETECKMNEGIVKLYNEGCCKICKREERICQKVIIKSVIRKQDCMSQSPINVASCDGKCPSATIYNINIESHLRFCKCCRENGVRNLSVPLYCSGNGTEIMYTLQEPIDCTCQWN

SEQ ID NO: 60468 - protein, 2344 aa, Homo sapiens
  Payload ID: 12097
  Gene Symbol: OTOGL
  Gene Name: otogelin-like
  ENSP ID: ENSP00000400895
MIPWSIFLLHVLLFSLQEYICASSILMGTSKNGFNENRQKRALLAAQFEATSPRYFFHDAINWGESKIKGSCPYECLNGAFCSKTGTCDCQIFQALGTRCQIIPNMGNGRDGICKTWGQYHFETFDGIYYYFPGNCSYIFAKDCGDLEPRYTVWVHNSPKCLGSVYSCYRSISLFFSNQEEIRIYGHEIKKNGISLTLPQTIGQIFIEKLADYILVKTTFGFSLAWDGISGIYLKLSEDHKGKSCGLCGNYNDIQSDDFIILQEDYTEDIAMFANSWSVQTPDDTKCVLTPSDFPNPCSSGMPAFEAIFFKCQILLQFPFLSCHEYIDPYLYIASCVNDLCKTDDDETYCRAATEYARACSHAGYPIQDWRDDFPACTDKCDDSFVHRDCISCCPPTCTFEKQCLGSNLHCLDGCYCPDGLVMDNGTCISLENCPCGFHGLAYSVGSKIEQECTECVCVGGVWNCTEQDCPVQCSVVGDSHFTTFDGRHYSFIGMCQYILVKGTGKDKFTITLQKAPCEQNLGLVCLQSITLILEDDFNKQVTLGRGGQILTSPNQGFNLNGIVEIQTLSSLFILLKTTFGLKILFAIDGERIYIQLTSAWKRRTLGLCGTFNGNIRDDFLSPSGMIEGTPQLHANAWRVSSTCFAPVHVPVVDPCNINQQNIGYAAHCDVIHQELFAPCHIYISPGLYYQLCRHDACKCGSSCLCNALAHYAYLCGQHGVPIDFRTQISFCAVVCQKGMLYHHCSSFCLHSCISLSSPEQCSDDCAEGCNCPEGKFYEDTLNFCVPIFHCRCHYRGSVYQPGELIPTPSGLCQCSNGTVKCDELATPSAVHICPEGKEYFDCRFPDPELPAGGVNCETTCANLAMNFTCTPSSPCISGCVCAPGMAEHRGKCYVPESCPCIWKDWEYLSGEVIATPCYTCVCRRGMFNCTYYPCPAVCTIYGDRHYYSFDGLEYDYISDCQVFLIKSADDSDISVIAQNKKCFDNDIVCSKSVLISVGDTEIYLNDTPYKQKQSGFFLENKSTYQLWKAGYYIVVYFPEKDITILWDRKTTIHIKVGPQWKNKLSGLCGNFDKCTSNDMTTSNNLEVRNARVFGDSWALGQCESPDETIKPCEAHQNKFPYAKKECSILYSDIFASCRNVIDVTSFAKNCHEDTCNCNLGGDCECLCTSIAAYAYKCCQEGISIHWRSSTVCSLDCEYYNEGLGEGPYMLASYGQSGLVLGANMTSRSVFCLPRSSVHTSLFFYFMITPGLFKEKVSSLALVSLESAERPNYFLYVHDNDTLSLELWEANSAFHRRATFFHHQGLWIPGYSAFELYSKKGFFIIFTDSSVKASKYDDSEEFKHSSSFSIEEIQAAVPYRKMCEWRYEPCATPCFKTCSDPEALACKFLPPVEGCLPYCPKNMILDEVTLKCVYPRDCIPVIPTEPTLMPPAKPTVPMFTVWEMITPSDITVFDMLTPTTGLECEPQKFDPVYDCSQYICLNMEWQLYNWSLNCPKDVEMPDCGFRGRPVQVNSDICCPEWECPCRCSMLSELSIITFDGNNAALYSMASYILVRIPGEIIVAHIEKCSMNQNGNSLKKLAPSGRISGLCFKKLNVTTPIHKIIVNRLARKVEVDSIVVPLPFSSQELSIEDSGSMYVITTPAGLIIKWSHLTGIIDIHFGFRFNLSSYTEGLCGICNEDPDDDLRMQNGTIITNMEDIGLFIESWEIEKSFEVTMRRPVRNCTEHDCSQCIDLLNRRIFIPCHDKVSPEDFCEKMWINYTYFWNYECDALSAYVALCNKFDICIQWRTPDYCSLSCPEGKEYQPCVRPCEARTCLNQWFYGHTSCLNLREDCVCKVGTILHRPHSAQCIPEKECACTDSEDQPRTAGEIWNGGIDECTLYKCLENGSIIPIEPDCDEEPTPVCEREAEVVMGIIDKWTCCSKEVCGCDTTLCETSIPTCTNSQKLIVGHSPLSCCPQYKCECDPLKCPSISTPECREDQFMIQVRQEEPCCFSPFCVCESCTKPVPLCHDGEFLTVDLNSTHFCCPQYYCVCEPNLCPMPLLNCAEDMNLVKENVSGQCCPTWHCECNCENLIMPTCEVGEFTAIDHNFQSDCGCIQYLCEKDDVCVFQEVSVLNPGQSMIKYLEEDFCYAIECLEEKDNHTGFHTLNFTLVNCSKKCDVHQVYTPSPSDYGCCGTCKNVSCKFHMENGTSVVYAVGSTWHYNCTTYECVKTDEGAIILNYTMVCPPFNETECKMNEGIVKLYNEGCCKICKREERICQKVIIKSVIRKQDCMSQSPINVASCDGKCPSATIYNINIESHLRFCKCCRENGVRNLSVPLYCSGNGTEIMYTLQEPIDCTCQWN

SEQ ID NO: 60469 - protein, 2332 aa, Homo sapiens
  Payload ID: 12097
  Gene Symbol: OTOGL
  Gene Name: otogelin-like
  Uniprot ID: Q3ZCN5
  ENSP ID: ENSP00000447211
MIPWSIFLLHVLLFSLQEYICASSILMGTSKNGFNENRQKRALLAAQFEATSPRYFFHDAINWGESKIKGSCPYECLNGAFCSKTGTCDCQIFQALGTRCQIIPNMGNGRDGICKTWGQYHFETFDGIYYYFPGNCSYIFAKDCGDLEPRYTVWVHNSPKCLGSVYSCYRSISLFFSNQEEIRIYGHEIKKNGISLTLPQTIGQIFIEKLADYILVKTTFGFSLAWDGISGIYLKLSEDHKGKSCGLCGNYNDIQSDDFIILQEDYTEDIAMFANSWSVQTPDDTKCVLTPSDFPNPCSSGMPAFEAIFFKCQILLQFPFLSCHEYIDPYLYIASCVNDLCKTDDDETYCRAATEYARACSHAGYPIQDWRDDFPACTDKCDDSFVHRDCISCCPPTCTFEKQCLGSNLHCLDGCYCPDGLVMDNGTCISLENCPCGFHGLAYSVGSKIEQECTECVCVGGVWNCTEQDCPVQCSVVGDSHFTTFDGRHYSFIGMCQYILVKGTGKDKFTITLQKAPCEQNLGLVCLQSITLILEDDFNKQVTLGRGGQILTSPNQGFNLNGIVEIQTLSSLFILLKTTFGLKILFAIDGERIYIQLTSAWKRRTLGLCGTFNGNIRDDFLSPSGMIEGTPQLHANAWRVSSTCFAPVHVPVVDPCNINQQNIGYAAHCDVIHQELFAPCHIYISPGLYYQLCRHDACKCGSSCLCNALAHYAYLCGQHGVPIDFRTQISFCAVVCQKGMLYHHCSSFCLHSCISLSSPEQCSDDCAEGCNCPEGKFYEDTLNFCVPIFHCRCHYRGSVYQPGELIPTPSGLCQCSNGTVKCDELATPSAVHICPEGKEYFDCRFPDPELPAGGVNCETTCANLAMNFTCTPSSPCISGCVCAPGMAEHRGKCYVPESCPCIWKDWEYLSGEVIATPCYTCVCRRGMFNCTYYPCPAVCTIYGDRHYYSFDGLEYDYISDCQVFLIKSADDSDISVIAQNKKCFDNDIVCSKSVLISVGDTEIYLNDTPYKQKQSGFFLENKSTYQLWKAGYYIVVYFPEKDITILWDRKTTIHIKVGPQWKNKLSGLCGNFDKCTSNDMTTSNNLEVRNARVFGDSWALGQCESPDETIKPCEAHQNKFPYAKKECSILYSDIFASCRNVIDVTSFAKNCHEDTCNCNLGGDCECLCTSIAAYAYKCCQEGISIHWRSSTVCSLDCEYYNEGLGEGPYMLASYGQSGLVLGANMTSRSVFCLPRSSVHTSLFFYFMITPGLFKEKVSSLALVSLESAERPNYFLYVHDNDTLSLELWEANSAFHRRATFFHHQGLWIPGYSAFELYSKKGFFIIFTDSSVKASKYDDSEEFKHSSSFSIEEIQAAVPYRKMCEWRYEPCATPCFKTCSDPEALACKFLPPVEGCLPYCPKNMILDEVTLKCVYPRDCIPVIPTEPTLMPPAKPTVPITVFDMLTPTTGLECEPQKFDPVYDCSQYICLNMEWQLYNWSLNCPKDVEMPDCGFRGRPVQVNSDICCPEWECPCRCSMLSELSIITFDGNNAALYSMASYILVRIPGEIIVAHIEKCSMNQNGNSLKKLAPSGRISGLCFKKLNVTTPIHKIIVNRLARKVEVDSIVVPLPFSSQELSIEDSGSMYVITTPAGLIIKWSHLTGIIDIHFGFRFNLSSYTEGLCGICNEDPDDDLRMQNGTIITNMEDIGLFIESWEIEKSFEVTMRRPVRNCTEHDCSQCIDLLNRRIFIPCHDKVSPEDFCEKMWINYTYFWNYECDALSAYVALCNKFDICIQWRTPDYCSLSCPEGKEYQPCVRPCEARTCLNQWFYGHTSCLNLREDCVCKVGTILHRPHSAQCIPEKECACTDSEDQPRTAGEIWNGGIDECTLYKCLENGSIIPIEPDCDEEPTPVCEREAEVVMGIIDKWTCCSKEVCGCDTTLCETSIPTCTNSQKLIVGHSPLSCCPQYKCECDPLKCPSISTPECREDQFMIQVRQEEPCCFSPFCVCESCTKPVPLCHDGEFLTVDLNSTHFCCPQYYCVCEPNLCPMPLLNCAEDMNLVKENVSGQCCPTWHCECNCENLIMPTCEVGEFTAIDHNFQSDCGCIQYLCEKDDVCVFQEVSVLNPGQSMIKYLEEDFCYAIECLEEKDNHTGFHTLNFTLVNCSKKCDVHQVYTPSPSDYGCCGTCKNVSCKFHMENGTSVVYAVGSTWHYNCTTYECVKTDEGAIILNYTMVCPPFNETECKMNEGIVKLYNEGCCKICKREERICQKVIIKSVIRKQDCMSQSPINVASCDGKCPSATIYNINIESHLRFCKCCRENGVRNLSVPLYCSGNGTEIMYTLQEPIDCTCQWN

SEQ ID NO: 60470 - protein, 166 aa, Homo sapiens
  Payload ID: 12097
  Gene Symbol: OTOGL
  Gene Name: otogelin-like
  ENSP ID: ENSP00000449296
  MOD_RES (1)..(1): Any amino acid
XHSPLSCCPQYKCECDPLKCPSISTPECREDQFMIQVRQEEPCCFSPFCVCESCTKPVPLCHDGEFLTVDLNSTHFCCPQYYCVCEPNLCPMPLLNCAEDMNLVKENVSGQCCPTWHCECNCENLIMPTCEVQPCADADIRTLGCLGRADQEHFHEAKFLRENLLQ

SEQ ID NO: 60471 - protein, 266 aa, Homo sapiens
  Payload ID: 12097
  Gene Symbol: OTOGL
  Gene Name: otogelin-like
  ENSP ID: ENSP00000449641
QVRQEEPCCFSPFCVCESCTKPVPLCHDGEFLTVDLNSTHFCCPQYYCVCEPNLCPMPLLNCAEDMNLVKENVSGQCCPTWHCECNCENLIMPTCEVGEFTAIDHNFQSDCGCIQYLCEKDDVCVFQEVSVLNPGQSMIKYLEEDFCYAIECLEEKDNHTGFHTLNFTLVNCSKKCDVHQVYTPSPSDYGCCGTCKNVSCKFHMENGTSVVYAVGSTWHYNCTTYECVKTDEGAIILNYTMVCPPFNETECKMVCTLLYLRKFIII

SEQ ID NO: 60472 - protein, 477 aa, Homo sapiens
  Payload ID: 12098
  Gene Symbol: OTOL1
  Gene Name: otolin 1
  Uniprot ID: A6NHN0
  ENSP ID: ENSP00000330808
MWMFSWLCAILIILAIAGMNTIAKTTPHTKFTKKSEEREMPKGLKPSSGPPPEEEETLFTEMAEMAEPITKPSALDSVFGTATLSPFENFTLDPADFFLNCCDCCSPVPGQKGEPGETGQPGPKGEAGNLGIPGPPGVVGPQGPRGYKGEKGLKGERGDQGVPGYPGKPGAQGEPGPKGDKGNIGLGGVKGQKGSKGDTCGNCTKGEKGDQGAMGSPGLHGGPGAKGEKGEMGEKGEMGDKGCCGDSGERGGKGQKGEGGMKGEKGSKGDSGMEGKSGRNGLPGAKGDPGIKGEKGELGPPGLLGPTGPKGDIGNKGVRGPTGKKGSRGFKGSKGELARVPRSAFSAGLSKPFPPPNIPIKFEKILYNDQGNYSPVTGKFNCSIPGTYVFSYHITVRGRPARISLVAQNKKQFKSRETLYGQEIDQASLLVILKLSAGDQVWLEVSKDWNGVYVSAEDDSIFTGFLLYPEETSGISP

SEQ ID NO: 60473 - protein, 612 aa, Homo sapiens
  Payload ID: 12099
  Gene Symbol: OTOP1
  Gene Name: otopetrin 1
  Uniprot ID: Q7RTM1
  ENSP ID: ENSP00000296358
MLEGLGSPASPRAAASASVAGSSGPAACSPPSSSAPRSPESPAPRRGGVRASVPQKLAEMLSSQYGLIVFVAGLLLLLAWAVHAAGVSKSDLLCFLTALMLLQLLWMLWYVGRSSAHRRLFRLKDTHAGAGWLRGSITLFAVITVILGCLKIGYFIGFSECLSATEGVFPVTHSVHTLLQVYFLWGHAKDIIQSFKTLERFGVIHSVFTNLLLWANGVLNESKHQLNEHKERLITLGFGNITTVLDDHTPQCNCTPPTLCTAISHGIYYLYPFNIEYQILASTMLYVLWKNIGRKVDSHQHQKMQFKSDGVMVGAVLGLTVLAATIAVVVVYLIHIGRSKTKSESALIMFYLYAITLLMLMGAAGLAGIRIYRIDEKSLDESKNPARKLDSDLLVGTASGSWLISWGSILAILCAEGHPRYTWYNLPYSILAIVEKYIQNLFIFESIHREPEKLSEDIQTLRVVTVCNGNTMPLASSCPKSGGVARDVAPQGKDMPPAANGNVCMRESHDKEEEKQEESSWGGSPSPVRLPRFLQGNAKRKVLRNIAAFLFLCNISLWIPPAFGCRPEYDNGLEEIVFGFEPWIIVVNLAMPFSIFYRMHAAASLFEVYCKI

SEQ ID NO: 60474 - protein, 562 aa, Homo sapiens
  Payload ID: 12100
  Gene Symbol: OTOP2
  Gene Name: otopetrin 2
  Uniprot ID: Q7RTS6
  ENSP ID: ENSP00000332528
MSEELAQGPKESPPAPRAGPREVWKKGGRLLSVLLAVNVLLLACTLISGGAFNKVAVYDTDVFALLTAMMLLATLWILFYLLRTVRCPCAVPYRDAHAGPIWLRGGLVLFGICTLIMDVFKTGYYSSFFECQSAIKILHPLIQAVFVIIQTYFLWVSAKDCVHVHLDLTWCGLMFTLTTNLAIWMAAVVDESVHQSHSYSSSHSNASHARLISDQHADNPVGGDSCLCSTAVCQIFQQGYFYLYPFNIEYSLFASTMLYVMWKNVGRFLASTPGHSHTPTPVSLFRETFFAGPVLGLLLFVVGLAVFIIYEVQVSGDGSRTRQALVIYYSFNIVCLGLTTLVSLSGSIIYRFDRRAMDHHKNPTRTLDVALLMGAALGQYAISYYSIVAVVAGTPQDLLAGLNLTHALLMIAQHTFQNMFIIESLHRGPPGAEPHSTHPKEPCQDLTFTNLDALHTLSACPPNPGLVSPSPSDQREAVAIVSTPRSQWRRQCLKDISLFLLLCNVILWIMPAFGARPHFSNTVEVDFYGYSLWAVIVNICLPFGIFYRMHAVSSLLEVYVLS

SEQ ID NO: 60475 - protein, 562 aa, Homo sapiens; identical to SEQ ID NO: 60474
  Payload ID: 12100
  Gene Symbol: OTOP2
  Gene Name: otopetrin 2
  Uniprot ID: Q7RTS6
  ENSP ID: ENSP00000463837

SEQ ID NO: 60476 - protein, 596 aa, Homo sapiens
  Payload ID: 12101
  Gene Symbol: OTOP3
  Gene Name: otopetrin 3
  Uniprot ID: Q7RTS5
  ENSP ID: ENSP00000328090
MGRGARAAAAQSRWGRASRASVSPGRTIRSAPAVGEAQETEAAPEKENRVDVGAEERAAATRPRQKSWLVRHFSLLLRRDRQAQKAGQLFSGLLALNVVFLGGAFICSMIFNKVAVTLGDVWILLATLKVLSLLWLLYYVASTTRRPHAVLYQDPHAGPLWVRGSLVLFGSCTFCLNIFRVGYDVSHIRCKSQLDLVFSVIEMVFIGVQTWVLWKHCKDCVRVQTNFTRCGLMLTLATNLLLWVLAVTNDSMHREIEAELGILMEKSTGNETNTCLCLNATACEAFRRGFLMLYPFSTEYCLICCAVLFVMWKNVGRHVAPHMGAHPATAPFHLHGAIFGPLLGLLVLLAGVCVFVLFQIEASGPAIACQYFTLYYAFYVAVLPTMSLACLAGTAIHGLEERELDTVKNPTRSLDVVLLMGAALGQMGIAYFSIVAIVAKRPHELLNRLILAYSLLLILQHIAQNLFIIEGLHRRPLWETVPEGLAGKQEAEPPRRGSLLELGQGLQRASLAYIHSYSHLNWKRRALKEISLFLILCNITLWMMPAFGIHPEFENGLEKDFYGYQIWFAIVNFGLPLGVFYRMHSVGGLVEVYLGA

SEQ ID NO: 60477 - protein, 46 aa, Homo sapiens
  Payload ID: 12101
  Gene Symbol: OTOP3
  Gene Name: otopetrin 3
  ENSP ID: ENSP00000464577
MRFPKSTEKSMGRGARAAAAQSRWGRASRASVSPGRTIRSAPAVGG

SEQ ID NO: 60478 - protein, 128 aa, Homo sapiens
  Payload ID: 12102
  Gene Symbol: OTOR
  Gene Name: otoraplin
  Uniprot ID: Q9NRC9
  ENSP ID: ENSP00000246081
MARILLLFLPGLVAVCAVHGIFMDRLASKKLCADDECVYTISLASAQEDYNAPDCRFINVKKGQQIYVYSKLVKENGAGEFWAGSVYGDGQDEMGVVGYFPRNLVKEQRVYQEATKEVPTTDIDFFCE

SEQ ID NO: 60479 - protein, 89 aa, Homo sapiens
  Payload ID: 12103
  Gene Symbol: OTOS
  Gene Name: otospiralin
  Uniprot ID: Q8NHW6
  ENSP ID: ENSP00000322486
MQACMVPGLALCLLLGPLAGAKPVQEEGDPYAELPAMPYWPFSTSDFWNYVQHFQALGAYPQIEDMARTFFAHFPLGSTLGFHVPYQED

SEQ ID NO: 60480 - protein, 89 aa, Homo sapiens; identical to SEQ ID NO: 60479
  Payload ID: 12103
  Gene Symbol: OTOS
  Gene Name: otospiralin
  Uniprot ID: Q8NHW6
  ENSP ID: ENSP00000375849

SEQ ID NO: 60481 - protein, 481 aa, Homo sapiens
  Payload ID: 12104
  Gene Symbol: OTUD1
  Gene Name: OTU deubiquitinase 1
  Uniprot ID: Q5VV17
  ENSP ID: ENSP00000365678
MQLYSSVCTHYPAGAPGPTAAAPAPPAAATPFKVSLQPPGAAGAAPEPETGECQPAAAAEHREAAAVPAAKMPAFSSCFEVVSGAAAPASAAAGPPGASCKPPLPPHYTSTAQITVRALGADRLLLHGPDPVPGAAGSAAAPRGRCLLLAPAPAAPVPPRRGSSAWLLEELLRPDCPEPAGLDATREGPDRNFRLSEHRQALAAAKHRGPAATPGSPDPGPGPWGEEHLAERGPRGWERGGDRCDAPGGDAARRPDPEAEAPPAGSIEAAPSSAAEPVIVSRSDPRDEKLALYLAEVEKQDKYLRQRNKYRFHIIPDGNCLYRAVSKTVYGDQSLHRELREQTVHYIADHLDHFSPLIEGDVGEFIIAAAQDGAWAGYPELLAMGQMLNVNIHLTTGGRLESPTVSTMIHYLGPEDSLRPSIWLSWLSNGHYDAVFDHSYPNPEYDNWCKQTQVQRKRDEELAKSMAISLSKMYIEQNACS

SEQ ID NO: 60482 - protein, 398 aa, Homo sapiens
  Payload ID: 12105
  Gene Symbol: OTUD3
  Gene Name: OTU deubiquitinase 3
  Uniprot ID: Q5T2D3
  ENSP ID: ENSP00000364261
MSRKQAAKSRPGSGSRKAEAERKRDERAARRALAKERRNRPESGGGGGCEEEFVSFANQLQALGLKLREVPGDGNCLFRALGDQLEGHSRNHLKHRQETVDYMIKQREDFEPFVEDDIPFEKHVASLAKPGTFAGNDAIVAFARNHQLNVVIHQLNAPLWQIRGTEKSSVRELHIAYRYGEHYDSVRRINDNSEAPAHLQTDFQMLHQDESNKREKIKTKGMDSEDDLRDEVEDAVQKVCNATGCSDFNLIVQNLEAENYNIESAIIAVLRMNQGKRNNAEENLEPSGRVLKQCGPLWEEGGSGARIFGNQGLNEGRTENNKAQASPSEENKANKNQLAKVTNKQRREQQWMEKKKRQEERHRHKALESRGSHRDNNRSEAEANTQVTLVKTFAALNI

SEQ ID NO: 60483 - protein, 1114 aa, Homo sapiens
  Payload ID: 12106
  Gene Symbol: OTUD4
  Gene Name: OTU deubiquitinase 4
  Uniprot ID: Q01804
  ENSP ID: ENSP00000395487
MEAAVGVPDGGDQGGAGPREDATPMDAYLRKLGLYRKLVAKDGSCLFRAVAEQVLHSQSRHVEVRMACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCKSKTAAAAADVNGFKPLSGNEQLKNNGNSTSLPLSRKVLKSLNPAVYRNVEYEIWLKSKQAQQKRDYSIAAGLQYEVGDKCQVRLDHNGKFLNADVQGIHSENGPVLVEELGKKHTSKNLKAPPPESWNTVSGKKMKKPSTSGQNFHSDVDYRGPKNPSKPIKAPSALPPRLQHPSGVRQHAFSSHSSGSQSQKFSSEHKNLSRTPSQIIRKPDRERVEDFDHTSRESNYFGLSPEERREKQAIEESRLLYEIQNRDEQAFPALSSSSVNQSASQSSNPCVQRKSSHVGDRKGSRRRMDTEERKDKDSIHGHSQLDKRPEPSTLENITDDKYATVSSPSKSKKLECPSPAEQKPAEHVSLSNPAPLLVSPEVHLTPAVPSLPATVPAWPSEPTTFGPTGVPAPIPVLSVTQTLTTGPDSAVSQAHLTPSPVPVSIQAVNQPLMPLPQTLSLYQDPLYPGFPCNEKGDRAIVPPYSLCQTGEDLPKDKNILRFFFNLGVKAYSCPMWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLSYQADLESETPGQLLHADYEESLSGKNMFPQPSFGPNPFLGPVPIAPPFFPHVWYGYPFQGFIENPVMRQNIVLPSDEKGELDLSLENLDLSKDCGSVSTVDEFPEARGEHVHSLPEASVSSKPDEGRTEQSSQTRKADTALASIPPVAEGKAHPPTQILNRERETVPVELEPKRTIQSLKEKTEKVKDPKTAADVVSPGANSVDSRVQRPKEESSEDENEVSNILRSGRSKQFYNQTYGSRKYKSDWGYSGRGGYQHVRSEESWKGQPSRSRDEGYQYHRNVRGRPFRGDRRRSGMGDGHRGQHT

SEQ ID NO: 60484 - protein, 1049 aa, Homo sapiens
  Payload ID: 12106
  Gene Symbol: OTUD4
  Gene Name: OTU deubiquitinase 4
  Uniprot ID: Q01804
  ENSP ID: ENSP00000409279
MACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCKSKTAAAAADVNGFKPLSGNEQLKNNGNSTSLPLSRKVLKSLNPAVYRNVEYEIWLKSKQAQQKRDYSIAAGLQYEVGDKCQVRLDHNGKFLNADVQGIHSENGPVLVEELGKKHTSKNLKAPPPESWNTVSGKKMKKPSTSGQNFHSDVDYRGPKNPSKPIKAPSALPPRLQHPSGVRQHAFSSHSSGSQSQKFSSEHKNLSRTPSQIIRKPDRERVEDFDHTSRESNYFGLSPEERREKQAIEESRLLYEIQNRDEQAFPALSSSSVNQSASQSSNPCVQRKSSHVGDRKGSRRRMDTEERKDKDSIHGHSQLDKRPEPSTLENITDDKYATVSSPSKSKKLECPSPAEQKPAEHVSLSNPAPLLVSPEVHLTPAVPSLPATVPAWPSEPTTFGPTGVPAPIPVLSVTQTLTTGPDSAVSQAHLTPSPVPVSIQAVNQPLMPLPQTLSLYQDPLYPGFPCNEKGDRAIVPPYSLCQTGEDLPKDKNILRFFFNLGVKAYSCPMWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLSYQADLESETPGQLLHADYEESLSGKNMFPQPSFGPNPFLGPVPIAPPFFPHVWYGYPFQGFIENPVMRQNIVLPSDEKGELDLSLENLDLSKDCGSVSTVDEFPEARGEHVHSLPEASVSSKPDEGRTEQSSQTRKADTALASIPPVAEGKAHPPTQILNRERETVPVELEPKRTIQSLKEKTEKVKDPKTAADVVSPGANSVDSRVQRPKEESSEDENEVSNILRSGRSKQFYNQTYGSRKYKSDWGYSGRGGYQHVRSEESWKGQPSRSRDEGYQYHRNVRGRPFRGDRRRSGMGDGHRGQHT

SEQ ID NO: 60485 - protein, 139 aa, Homo sapiens
  Payload ID: 12106
  Gene Symbol: OTUD4
  Gene Name: OTU deubiquitinase 4
  ENSP ID: ENSP00000423453
MACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDS

SEQ ID NO: 60486 - protein, 145 aa, Homo sapiens
  Payload ID: 12106
  Gene Symbol: OTUD4
  Gene Name: OTU deubiquitinase 4
  Uniprot ID: Q01804
  ENSP ID: ENSP00000424192
MACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCK

SEQ ID NO: 60487 - protein, 372 aa, Homo sapiens
  Payload ID: 12106
  Gene Symbol: OTUD4
  Gene Name: OTU deubiquitinase 4
  ENSP ID: ENSP00000425972
MACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCKSKTAAAAADVNGFKPLSGNELKNNGNSTSLPLSRKVLKSLNPAVYRNVEYEIWLKSKQAQQKRDYSIAAGLQYEVGDKCQVRLDHNGKFLNADVQGIHSENGPVLVEELGKKHTSKNLKAPPPESWNTVSGKKMKKPSTSGQNFHSDVDYRGPKNPSKPIKAPSALPPRLQHPSGVRQHAFSSHSSGSQSQKFSSEHKNLSRTPSQIIRKPDRERVEDFDHTSRESN

SEQ ID NO: 60488 - protein, 571 aa, Homo sapiens
  Payload ID: 12107
  Gene Symbol: OTUD5
  Gene Name: OTU deubiquitinase 5
  Uniprot ID: Q96G74
  ENSP ID: ENSP00000156084
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTGTSAVEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 60489 - protein, 566 aa, Homo sapiens
  Payload ID: 12107
  Gene Symbol: OTUD5
  Gene Name: OTU deubiquitinase 5
  Uniprot ID: Q96G74
  ENSP ID: ENSP00000365671
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 60490 - protein, 566 aa, Homo sapiens; identical to SEQ ID NO: 60489
  Payload ID: 12107
  Gene Symbol: OTUD5
  Gene Name: OTU deubiquitinase 5
  Uniprot ID: Q96G74
  ENSP ID: ENSP00000379969

SEQ ID NO: 60491 - protein, 444 aa, Homo sapiens
  Payload ID: 12107
  Gene Symbol: OTUD5
  Gene Name: OTU deubiquitinase 5
  ENSP ID: ENSP00000390767
GVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTGTSAVEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 60492 - protein, 349 aa, Homo sapiens
  Payload ID: 12107
  Gene Symbol: OTUD5
  Gene Name: OTU deubiquitinase 5
  Uniprot ID: Q96G74
  ENSP ID: ENSP00000401629
MKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 60493 - protein, 542 aa, Homo sapiens [sequence omitted]

SEQ ID NO: 60494 - protein, 288 aa, Homo sapiens
  Payload ID: 12108
  Gene Symbol: OTUD6A
  Gene Name: OTU deubiquitinase 6A
  Uniprot ID: Q7L8S5
  ENSP ID: ENSP00000339389
MDDPKSEQQRILRRHQRERQELQAQIRSLKNSVPKTDKTKRKQLLQDVARMEAEMAQKHRQELEKFQDDSSIESVVEDLAKMNLENRPPRSSKAHRKRERMESEERERQESIFQAEMSEHLAGFKREEEEKLAAILGARGLEMKAIPADGHCMYRAIQDQLVFSVSVEMLRCRTASYMKKHVDEFLPFFSNPETSDSFGYDDFMIYCDNIVRTTAWGGQLELRALSHVLKTPIEVIQADSPTLIIGEEYVKKPIILVYLRYAYSLGEHYNSVTPLEAGAAGGVLPRLL

SEQ ID NO: 60495 - protein, 926 aa, Homo sapiens
  Payload ID: 12109
  Gene Symbol: OTUD7A
  Gene Name: OTU deubiquitinase 7A
  Uniprot ID: Q8TE49
  ENSP ID: ENSP00000305926
MVSSVLPNPTSAECWAALLHDPMTLDMDAVLSDFVRSTGAEPGLARDLLEGKNWDLTAALSDYEQLRQVHTANLPHVFNEGRGPKQPEREPQPGHKVERPCLQRQDDIAQEKRLSRGISHASSAIVSLARSHVASECNNEQFPLEMPIYTFQLPDLSVYSEDFRSFIERDLIEQATMVALEQAGRLNWWSTVCTSCKRLLPLATTGDGNCLLHAASLGMWGFHDRDLVLRKALYTMMRTGAEREALKRRWRWQQTQQNKEEEWEREWTELLKLASSEPRTHFSKNGGTGGGVDNSEDPVYESLEEFHVFVLAHILRRPIVVVADTMLRDSGGEAFAPIPFGGIYLPLEVPPNRCHCSPLVLAYDQAHFSALVSMEQRDQQREQAVIPLTDSEHKLLPLHFAVDPGKDWEWGKDDNDNARLAHLILSLEAKLNLLHSYMNVTWIRIPSETRAPLAQPESPTASAGEDVQSLADSLDSDRDSVCSNSNSNNGKNGKDKEKEKQRKEKDKTRADSVANKLGSFSKTLGIKLKKNMGGLGGLVHGKMGRANSANGKNGDSAERGKEKKAKSRKGSKEESGASASTSPSEKTTPSPTDKAAGASPAEKGGGPRGDAWKYSTDVKLSLNILRAAMQGERKFIFAGLLLTSHRHQFHEEMIGYYLTSAQERFSAEQEQRRRDAATAAAAAAAAAAATAKRPPRRPETEGVPVPERASPGPPTQLVLKLKERPSPGPAAGRAARAAAGGTASPGGGARRASASGPVPGRSPPAPARQSVIHVQASGARDEACAPAVGALRPCATYPQQNRSLSSQSYSPARAAALRTVNTVESLARAVPGALPGAAGTAGAAEHKSQTYTNGFGALRDGLEFADADAPTARSNGECGRGGPGPVQRRCQRENCAFYGRAETEHYCSYCYREELRRRREARGARP

SEQ ID NO: 60496 - protein, 113 aa, Homo sapiens
  Payload ID: 12109
  Gene Symbol: OTUD7A
  Gene Name: OTU deubiquitinase 7A
  ENSP ID: ENSP00000453622
MVSSVLPNPTSAECWAALLHDPMTLDMDAVLSDFVRSTGAEPGLARDLLEAPPTVIHLPEPGRCCLHAVQGSRLHPVGQRVAVVSAHSPHPLLGPAFGFHRQKLGPDSRSERL

SEQ ID NO: 60497 - protein, 110 aa, Homo sapiens
  Payload ID: 12109
  Gene Symbol: OTUD7A
  Gene Name: OTU deubiquitinase 7A
  ENSP ID: ENSP00000453883
MVSSVLPNPTSAECWAALLHDPMTLDMDAVLSDFVRSTGAEPGLARDLLEGKNWDLTAALSDYEQLRQVHTANLPHVFNEGRGPKQPEREPQPGHKVERPCLQRQDDIAQ

SEQ ID NO: 60498 - protein, 427 aa, Homo sapiens
  Payload ID: 12110
  Gene Symbol: OTUD7B
  Gene Name: OTU deubiquitinase 7B
  ENSP ID: ENSP00000408231
MTLDMDAVLSDFVRSTGAEPGLARDLLEGKNWDVNAALSDFEQLRQVHAGNLPPSFSEGSGGSRTPEKGFSDREPTRPPRPILQRQDDIVQEKRLSRGISHASSSIVSLARSHVSSNGGGGGSNEHPLEMPICAFQLPDLTVYNEDFRSFIERDLIEQSMLVALEQAGRLNWWVSVDPTSQRLLPLATTGDGNCLLHAASLGMWGFHDRDLMLRKALYALMEKGVEKEALKRRWRWQQTQQNKESGLVYTEDEWQKEWNELIKLASSEPRMHLGTNGANCGGVESSEEPVYESLEEFHVFVLAHVLRRPIVVVADTMLRDSGGEAFAPIPFGGIYLPLEVPASQCHRSPLVLAYDQAHFSALVSMEQKENTKEQAVIPLTDSEYKLLPLHFAVDPGKGWEWGKDDSDNVRLASVILSLEVKLHLLHS

SEQ ID NO: 60499 - protein, 843 aa, Homo sapiens
  Payload ID: 12110
  Gene Symbol: OTUD7B
  Gene Name: OTU deubiquitinase 7B
  Uniprot ID: Q6GQQ9
  ENSP ID: ENSP00000462729
MTLDMDAVLSDFVRSTGAEPGLARDLLEGKNWDVNAALSDFEQLRQVHAGNLPPSFSEGSGGSRTPEKGFSDREPTRPPRPILQRQDDIVQEKRLSRGISHASSSIVSLARSHVSSNGGGGGSNEHPLEMPICAFQLPDLTVYNEDFRSFIERDLIEQSMLVALEQAGRLNWWVSVDPTSQRLLPLATTGDGNCLLHAASLGMWGFHDRDLMLRKALYALMEKGVEKEALKRRWRWQQTQQNKESGLVYTEDEWQKEWNELIKLASSEPRMHLGTNGANCGGVESSEEPVYESLEEFHVFVLAHVLRRPIVVVADTMLRDSGGEAFAPIPFGGIYLPLEVPASQCHRSPLVLAYDQAHFSALVSMEQKENTKEQAVIPLTDSEYKLLPLHFAVDPGKGWEWGKDDSDNVRLASVILSLEVKLHLLHSYMNVKWIPLSSDAQAPLAQPESPTASAGDEPRSTPESGDSDKESVGSSSTSNEGGRRKEKSKRDREKDKKRADSVANKLGSFGKTLGSKLKKNMGGLMHSKGSKPGGVGTGLGGSSGTETLEKKKKNSLKSWKGGKEEAAGDGPVSEKPPAESVGNGGSKYSQEVMQSLSILRTAMQGEGKFIFVGTLKMGHRHQYQEEMIQRYLSDAEERFLAEQKQKEAERKIMNGGIGGGPPPAKKPEPDAREEQPTGPPAESRAMAFSTGYPGDFTIPRPSGGGVHCQEPRRQLAGGPCVGGLPPYATFPRQCPPGRPYPHQDSIPSLEPGSHSKDGLHRGALLPPPYRVADSYSNGYREPPEPDGWAGGLRGLPPTQTKCKQPNCSFYGHPETNNFCSCCYREELRRREREPDGELLVHRF

SEQ ID NO: 60500 - protein, 352 aa, Homo sapiens
  Payload ID: 12111
  Gene Symbol: OTULIN
  Gene Name: OTU deubiquitinase with linear linkage specificity
  Uniprot ID: Q96BN8
  ENSP ID: ENSP00000284274
MSRGTMPQPEAWPGASCAETPAREAAATARDGGKAAASGQPRPEMQCPAEHEEDMYRAADEIEKEKELLIHERGASEPRLSVAPEMDIMDYCKKEWRGNTQKATCMKMGYEEVSQKFTSIRRVRGDNYCALRATLFQAMSQAVGLPPWLQDPELMLLPEKLISKYNWIKQWKLGLKFDGKNEDLVDKIKESLTLLRKKWAGLAEMRTAEARQIACDELFTNEAEEYSLYEAVKFLMLNRAIELYNDKEKGKEVPFFSVLLFARDTSNDPGQLLRNHLNQVGHTGGLEQVEMFLLAYAVRHTIQVYRLSKYNTEEFITVYPTDPPKDWPVVTLIAEDDRHYNIPVRVCEETSL

SEQ ID NO: 60501 - protein, 66 aa, Homo sapiens
  Payload ID: 12111
  Gene Symbol: OTULIN
  Gene Name: OTU deubiquitinase with linear linkage specificity
  ENSP ID: ENSP00000421928
  MOD_RES (1)..(1): Any amino acid
XATCMKMGYEEVSQKFTSIRRVRGDNYCALRATLFQAMSQAVGLPPWLQDPELMLVRCCCSYQKNS

SEQ ID NO: 60502 - protein, 84 aa, Homo sapiens
  Payload ID: 12111
  Gene Symbol: OTULIN
  Gene Name: OTU deubiquitinase with linear linkage specificity
  ENSP ID: ENSP00000424966
  MOD_RES (1)..(1): Any amino acid
XAMSQAVGLPPWLQDPELMLVEMFLLAYAVRHTIQVYRLSKYNTEEFITVYPTDPPKDWPVVTLIAEDDRHYNIPVRVCEETSL

SEQ ID NO: 60503 - protein, 58 aa, Homo sapiens
  Payload ID: 12111
  Gene Symbol: OTULIN
  Gene Name: OTU deubiquitinase with linear linkage specificity
  ENSP ID: ENSP00000427016
MSRGTMPQPEAWPGASCAETPAREAAATARDGGKAAASGQPRPEMQCPAEQTEIKRSS

SEQ ID NO: 60504 - protein, 271 aa, Homo sapiens
  Payload ID: 12112
  Gene Symbol: OTUB1
  Gene Name: OTU deubiquitinase, ubiquitin aldehyde binding 1
  Uniprot ID: Q96FW1
  ENSP ID: ENSP00000402551
MAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 60505 - protein, 272 aa, Homo sapiens
  Payload ID: 12112
  Gene Symbol: OTUB1
  Gene Name: OTU deubiquitinase, ubiquitin aldehyde binding 1
  ENSP ID: ENSP00000416973
MAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 60506 - protein, 280 aa, Homo sapiens
  Payload ID: 12112
  Gene Symbol: OTUB1
  Gene Name: OTU deubiquitinase, ubiquitin aldehyde binding 1
  ENSP ID: ENSP00000437453
MAAEEPQQQKQEPLGSDSEGVNCLAYDEAIMAQQDRIQQEDMTDPCLLQIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 60507 - protein, 170 aa, Homo sapiens
  Payload ID: 12112
  Gene Symbol: OTUB1
  Gene Name: OTU deubiquitinase, ubiquitin aldehyde binding 1
  ENSP ID: ENSP00000439142
MAAEEPQQQKQEPLGSDSEGVNCLAYDEAIMAQQDRIQQEFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 60508 - protein, 286 aa, Homo sapiens
  Payload ID: 12112
  Gene Symbol: OTUB1
  Gene Name: OTU deubiquitinase, ubiquitin aldehyde binding 1
  ENSP ID: ENSP00000440211
MAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQGVLVVSRVCVSLLCCPPGCSVCCPLPPDGQTKATFSFITSVSAQFQGCQGERQL

SEQ ID NO: 60509 - protein, 241 aa, Homo sapiens
  Payload ID: 12112
  Gene Symbol: OTUB1
  Gene Name: OTU deubiquitinase, ubiquitin aldehyde binding 1
  ENSP ID: ENSP00000441328
MAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 60510 - protein, 271 aa, Homo sapiens; identical to SEQ ID NO: 60504
  Payload ID: 12112
  Gene Symbol: OTUB1
  Gene Name: OTU deubiquitinase, ubiquitin aldehyde binding 1
  Uniprot ID: Q96FW1
  ENSP ID: ENSP00000444357

SEQ ID NO: 60511 - protein, 102 aa, Homo sapiens
  Payload ID: 12112
  Gene Symbol: OTUB1
  Gene Name: OTU deubiquitinase, ubiquitin aldehyde binding 1
  ENSP ID: ENSP00000444968
MMKPSWLSRTEFSKRLLCRTLWCQSGWSSRSYTRSMLKMTTSINRRSRTSTKSTRTSARPGLTATVSIGLSDSPTWRHCWMTARSCSGGEADLCRRPAGLLQ

SEQ ID NO: 60512 - protein, 234 aa, Homo sapiens
  Payload ID: 12113
  Gene Symbol: OTUB2
  Gene Name: OTU deubiquitinase, ubiquitin aldehyde binding 2
  Uniprot ID: Q96DC9
  ENSP ID: ENSP00000203664
MSETSFNLISEKCDILSILRDHPENRIYRRKIEELSKRFTAIRKTKGDGNCFYRALGYSYLESLLGKSREIFKFKERVLQTPNDLLAAGFEEHKFRNFFNAFYSVVELVEKDGSVSSLLKVFNDQSASDHIVQFLRLLTSAFIRNRADFFRHFIDEEMDIKDFCTHEVEPMATECDHIQITALSQALSIALQVEYVDEMDTALNHHVFPEAATPSVYLLYKTSHYNILYAADKH

SEQ ID NO: 60513 - protein, 73 aa, Homo sapiens
  Payload ID: 12113
  Gene Symbol: OTUB2
  Gene Name: OTU deubiquitinase, ubiquitin aldehyde binding 2
  Uniprot ID: Q96DC9
  ENSP ID: ENSP00000451283
MSETSFNLISEKCDILSILRDHPENRIYRRKIEELSKRFTAIRKTKGDGNCFYRALGYSYLESLLGKSREIFK

SEQ ID NO: 60514 - protein, 234 aa, Homo sapiens; identical to SEQ ID NO: 60512
  Payload ID: 12113
  Gene Symbol: OTUB2
  Gene Name: OTU deubiquitinase, ubiquitin aldehyde binding 2
  Uniprot ID: Q96DC9
  ENSP ID: ENSP00000478628

SEQ ID NO: 60515 - protein, 73 aa, Homo sapiens; identical to SEQ ID NO: 60513
  Payload ID: 12113
  Gene Symbol: OTUB2
  Gene Name: OTU deubiquitinase, ubiquitin aldehyde binding 2
  Uniprot ID: Q96DC9
  ENSP ID: ENSP00000487491

SEQ ID NO: 60516 - protein, 323 aa, Homo sapiens
  Payload ID: 12114
  Gene Symbol: OTUD6B
  Gene Name: OTU domain containing 6B
  ENSP ID: ENSP00000285420
MEPRVRVEGWKVPTSRCRFLLARVLGYLVVMEAVLTEELDEEEQLLRRHRKEKKELQAKIQGMKNAVPKNDKKRRKQLTEDVAKLEKEMEQKHREELEQLKLTTKENKIDSVAVNISNLVLENQPPRISKAQKRREKKAALEKEREERIAEAEIENLTGARHMESEKLAQILAARQLEIKQIPSDGHCMYKAIEDQLKEKDCALTVVALRSQTAEYMQSHVEDFLPFLTNPNTGDMYTPEEFQKYCEDIVNTAAWGGQLELRALSHILQTPIEIIQADSPPIIVGEEYSKKPLILVYMRHAYGLGEHYNSVTRLVNIVTENCS

SEQ ID NO: 60517 - protein, 293 aa, Homo sapiens
  Payload ID: 12114
  Gene Symbol: OTUD6B
  Gene Name: OTU domain containing 6B
  Uniprot ID: Q8N6M0
  ENSP ID: ENSP00000384190
MEAVLTEELDEEEQLLRRHRKEKKELQAKIQGMKNAVPKNDKKRRKQLTEDVAKLEKEMEQKHREELEQLKLTTKENKIDSVAVNISNLVLENQPPRISKAQKRREKKAALEKEREERIAEAEIENLTGARHMESEKLAQILAARQLEIKQIPSDGHCMYKAIEDQLKEKDCALTVVALRSQTAEYMQSHVEDFLPFLTNPNTGDMYTPEEFQKYCEDIVNTAAWGGQLELRALSHILQTPIEIIQADSPPIIVGEEYSKKPLILVYMRHAYGLGEHYNSVTRLVNIVTENCS

SEQ ID NO: 60518 - protein, 108 aa, Homo sapiens
  Payload ID: 12114
  Gene Symbol: OTUD6B
  Gene Name: OTU domain containing 6B
  ENSP ID: ENSP00000428528
MEAVLTEELDEEEQLLRRHRKEKKELQAKIQGMKNAVPKNDKKRRKQLTEDVAKLEKEMEQKHREELEQLKLTTKENKIDSVAVNISNLVLENQPPRISKAQKRRVPG

SEQ ID NO: 60519 - protein, 192 aa, Homo sapiens
  Payload ID: 12114
  Gene Symbol: OTUD6B
  Gene Name: OTU domain containing 6B
  Uniprot ID: Q8N6M0
  ENSP ID: ENSP00000481196
MISKEKKAALEKEREERIAEAEIENLTGARHMESEKLAQILAARQLEIKQIPSDGHCMYKAIEDQLKEKDCALTVVALRSQTAEYMQSHVEDFLPFLTNPNTGDMYTPEEFQKYCEDIVNTAAWGGQLELRALSHILQTPIEIIQADSPPIIVGEEYSKKPLILVYMRHAYGLGEHYNSVTRLVNIVTENCS

SEQ ID NO: 60520 - protein, 323 aa, Homo sapiens; identical to SEQ ID NO: 60516
  Payload ID: 12114
  Gene Symbol: OTUD6B
  Gene Name: OTU domain containing 6B
  ENSP ID: ENSP00000483706

SEQ ID NO: 60521 - protein, 273 aa, Homo sapiens
  Payload ID: 12115
  Gene Symbol: OAF
  Gene Name: out at first homolog
  Uniprot ID: Q86UD1
  ENSP ID: ENSP00000332613
MRLPGVPLARPALLLLLPLLAPLLGTGAPAELRVRVRLPDGQVTEESLQADSDADSISLELRKPDGTLVSFTADFKKDVKVFRALILGELEKGQSQFQALCFVTQLQHNEIIPSEAMAKLRQKNPRAVRQAEEVRGLEHLHMDVAVNFSQGALLSPHLHNVCAEAVDAIYTRQEDVRFWLEQGVDSSVFEALPKASEQAELPRCRQVGDHGKPCVCRYGLSLAWYPCMLKYCHSRDRPTPYKCGIRSCQKSYSFDFYVPQRQLCLWDEDPYPG

SEQ ID NO: 60522 - protein, 157 aa, Homo sapiens
  Payload ID: 12115
  Gene Symbol: OAF
  Gene Name: out at first homolog
  ENSP ID: ENSP00000431865
MAKLRQKNPRAVRQAEEVRGLEHLHMDVAVNFSQGALLSPHLHNVCAEAVDAIYTRQEDVRFWLEQGVDSSVFEALPKASEQAELPRCRQVGDHGKPCVCRYGLSLAWYPCMLKYCHSRDRPTPYKCGIRSCQKSYSFDFYVPQRQLCLWDEDPYPG

SEQ ID NO: 60523 - protein, 250 aa, Homo sapiens
  Payload ID: 12116
  Gene Symbol: ODF1
  Gene Name: outer dense fiber of sperm tails 1
  Uniprot ID: Q14990
  ENSP ID: ENSP00000285402
MAALSCLLDSVRRDIKKVDRELRQLRCIDEFSTRCLCDLYMHPYCCCDLHPYPYCLCYSKRSRSCGLCDLYPCCLCDYKLYCLRPSLRSLERKAIRAIEDEKRELAKLRRTTNRILASSCCSSNILGSVNVCGFEPDQVKVRVKDGKVCVSAERENRYDCLGSKKYSYMNICKEFSLPPCVDEKDVTYSYGLGSCVKIESPCYPCTSPCSPCSPCSPCNPCSPCNPCSPYDPCNPCYPCGSRFSCRKMIL

SEQ ID NO: 60524 - protein, 43 aa, Homo sapiens
  Payload ID: 12116
  Gene Symbol: ODF1
  Gene Name: outer dense fiber of sperm tails 1
  ENSP ID: ENSP00000430023
MESPCSPCSPCNPCSPCNPCSPYDPCNPCYPCGSRFSCRKMIL

SEQ ID NO: 60525 - protein, 824 aa, Homo sapiens
  Payload ID: 12117
  Gene Symbol: ODF2
  Gene Name: outer dense fiber of sperm tails 2
  Uniprot ID: Q5BJF6
  ENSP ID: ENSP00000342581
MKDRSSTPPLHVHVDENTPVHVHIKKLPKPSATSSQKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 60526 - protein, 638 aa, Homo sapiens
  Payload ID: 12117
  Gene Symbol: ODF2
  Gene Name: outer dense fiber of sperm tails 2
  Uniprot ID: Q5BJF6
  ENSP ID: ENSP00000361877
MSASSSGGSPRFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 60527 - protein, 824 aa, Homo sapiens; identical to SEQ ID NO: 60525
  Payload ID: 12117
  Gene Symbol: ODF2
  Gene Name: outer dense fiber of sperm tails 2
  Uniprot ID: Q5BJF6
  ENSP ID: ENSP00000361893

SEQ ID NO: 60528 - protein, 701 aa, Homo sapiens
  Payload ID: 12117
  Gene Symbol: ODF2
  Gene Name: outer dense fiber of sperm tails 2
  Uniprot ID: Q5BJF6
  ENSP ID: ENSP00000361901
MGELPTGCRKRRRKRGGAAARARLHPPRRLHGTTLASDFNDFIRRRFWAQPCRSWFPSCGKNGVTSLTQKKVLRAPCGAPSVTVTKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 60529 - protein, 805 aa, Homo sapiens
  Payload ID: 12117
  Gene Symbol: ODF2
  Gene Name: outer dense fiber of sperm tails 2
  Uniprot ID: Q5BJF6
  ENSP ID: ENSP00000377161
MKDRSSTPPLHVHVDENTPVHVHIKKLPKPSATSSQKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 60530 - protein, 657 aa, Homo sapiens
  Payload ID: 12117
  Gene Symbol: ODF2
  Gene Name: outer dense fiber of sperm tails 2
  Uniprot ID: Q5BJF6
  ENSP ID: ENSP00000377166
MADQQGPHQNRFPSCGKNGVTSLTQKKVLRAPCGAPSVTVTKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 60531 - protein, 805 aa, Homo sapiens; identical to SEQ ID NO: 60529
  Payload ID: 12117
  Gene Symbol: ODF2
  Gene Name: outer dense fiber of sperm tails 2
  Uniprot ID: Q5BJF6
  ENSP ID: ENSP00000394506

SEQ ID NO: 60532 - protein, 386 aa, Homo sapiens
  Payload ID: 12117
  Gene Symbol: ODF2
  Gene Name: outer dense fiber of sperm tails 2
  ENSP ID: ENSP00000395489
MGRNRYPPACWFPSCGKNGVTSLTQKKVLRAPCGAPSVTVTKSHKRGMKGDTVNVRRSVRVKTKVPWMPPGKSSARPVGCKWEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLES

SEQ ID NO: 60533 - protein, 576 aa, Homo sapiens
  Payload ID: 12117
  Gene Symbol: ODF2
  Gene Name: outer dense fiber of sperm tails 2
  Uniprot ID: Q5BJF6
  ENSP ID: ENSP00000396687
MKDRSSTPPLHVHVDENTPVHVHIKKLPKPSATSSQKSHKRGMKGDTVNVRRSVRVKTKVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 60534 - protein, 829 aa, Homo sapiens
  Payload ID: 12117
  Gene Symbol: ODF2
  Gene Name: outer dense fiber of sperm tails 2
  Uniprot ID: Q5BJF6
  ENSP ID: ENSP00000403453
MSASSSGGSPRFPSCGKNGVTSLTQKKVLRAPCGAPSVTVTKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 60535 - protein, 205 aa, Homo sapiens
  Payload ID: 12117
  Gene Symbol: ODF2
  Gene Name: outer dense fiber of sperm tails 2
  ENSP ID: ENSP00000407852
MSASSSGGSPRFPSCGKNGVTSLTQKKVLRAPCGAPSVTVTKSHKRGMKGDTVNVRRSVRVKTKVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKE

SEQ ID NO: 60536 - protein, 156 aa, Homo sapiens
  Payload ID: 12117
  Gene Symbol: ODF2
  Gene Name: outer dense fiber of sperm tails 2
  ENSP ID: ENSP00000415290
MSASSSGGSPRFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHE

SEQ ID NO: 60537 - protein, 638 aa, Homo sapiens
  Payload ID: 12117
  Gene Symbol: ODF2
  Gene Name: outer dense fiber of sperm tails 2
  Uniprot ID: Q5BJF6
  ENSP ID: ENSP00000437579
MGRNRYPPACWFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 60538 - protein, 829 aa, Homo sapiens; identical to SEQ ID NO: 60534
  Payload ID: 12117
  Gene Symbol: ODF2
  Gene Name: outer dense fiber of sperm tails 2
  Uniprot ID: Q5BJF6
  ENSP ID: ENSP00000473949

SEQ ID NO: 60539 - protein, 241 aa, Homo sapiens
  Payload ID: 12117
  Gene Symbol: ODF2
  Gene Name: outer dense fiber of sperm tails 2
  ENSP ID: ENSP00000474651
EIEAARRQFQSQLADLQQLPDILKITEAKLAECQDQLQGYERKNIDLTAIISDLRSRIEHQGDKLEMAREKHQASQKENKQLSLKVDELERLEALGPISVLFLGPETFSHLAVFCLVCGSVEGLEALEGTRQTSEEKLLPFQWKLEATSAQNIEFLQVIAKREEAIHQSQLRLEEKTRECGTLARQLESAIEDARRQVEQTKEHALSKERAAQNKILDLETQLSRTKTELSQLRRSRDDAD

SEQ ID NO: 60540 - protein, 144 aa, Homo sapiens
  Payload ID: 12117
  Gene Symbol: ODF2
  Gene Name: outer dense fiber of sperm tails 2
  ENSP ID: ENSP00000474949
MRFPSCGKNGVTSLTQKKVLRAPCGAPSVTVTKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKR

SEQ ID NO: 60541 - protein, 100 aa, Homo sapiens
  Payload ID: 12117
  Gene Symbol: ODF2
  Gene Name: outer dense fiber of sperm tails 2
  ENSP ID: ENSP00000475118
MSASSSGGSPRFPSCGKNGVTSLTQKKVLRAPCGAPSVTVTKSHKRGMKGDTVNVRRSVRVKTKVPWMPPGKSSARPVGCKWENPPHCLEITPPSSEKLV

SEQ ID NO: 60542 - protein, 620 aa, Homo sapiens
  Payload ID: 12118
  Gene Symbol: ODF2L
  Gene Name: outer dense fiber of sperm tails 2-like
  Uniprot ID: Q9ULJ1
  ENSP ID: ENSP00000294678
MEKAVNDGSHSEELFCHLKTISEKEDLPRCTSESHLSCLKQDILNEKTELEATLKEAELVTHSVELLLPLFKDTIEKINFENANLSALNLKISEQKEILIKELDTFKSVKLALEHLLRKRDYKQTGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQILKQWEEYSVLAWVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSDPETP

SEQ ID NO: 60543 - protein, 636 aa, Homo sapiens
  Payload ID: 12118
  Gene Symbol: ODF2L
  Gene Name: outer dense fiber of sperm tails 2-like
  Uniprot ID: Q9ULJ1
  ENSP ID: ENSP00000320165
MEKAVNDGSHSEELFCHLKTISEKEDLPRCTSESHLSCLKQDILNEKTELEATLKEAELVTHSVELLLPLFKDTIEKINFENANLSALNLKISEQKEILIKELDTFKSVKLALEHLLRKRDYKQTGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKLRFPCRITESKNMNILIVLDMLCYISSEKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSDPETP

SEQ ID NO: 60544 - protein, 591 aa, Homo sapiens
  Payload ID: 12118
  Gene Symbol: ODF2L
  Gene Name: outer dense fiber of sperm tails 2-like
  Uniprot ID: Q9ULJ1
  ENSP ID: ENSP00000359597
MEKAVNDGSHSEELFCHLKTISEKEDLPRCTSESHLSCLKQDILNEKTELEATLKEAELVTHSVELLLPLFKDTIEKINFENANLSALNLKISEQKEILIKELDTFKSVKLALEHLLRKRDYKQTGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 60545 - protein, 636 aa, Homo sapiens; identical to SEQ ID NO: 60543
  Payload ID: 12118
  Gene Symbol: ODF2L
  Gene Name: outer dense fiber of sperm tails 2-like
  Uniprot ID: Q9ULJ1
  ENSP ID: ENSP00000359600

SEQ ID NO: 60546 - protein, 49 aa, Homo sapiens
  Payload ID: 12118
  Gene Symbol: ODF2L
  Gene Name: outer dense fiber of sperm tails 2-like
  ENSP ID: ENSP00000378220
MLLENLTDNESENTNLKKKVFEKEAHIQELSCLFQSEKANTLKANRFSQ

SEQ ID NO: 60547 - protein, 54 aa, Homo sapiens
  Payload ID: 12118
  Gene Symbol: ODF2L
  Gene Name: outer dense fiber of sperm tails 2-like
  ENSP ID: ENSP00000431920
  MOD_RES (1)..(1): Any amino acid
XAAERRLHECQESLQCCKGKCADQEHTIRELQGQNMDHVADFEAVGRIFCLGMG

SEQ ID NO: 60548 - protein, 60 aa, Homo sapiens
  Payload ID: 12118
  Gene Symbol: ODF2L
  Gene Name: outer dense fiber of sperm tails 2-like
  ENSP ID: ENSP00000432632
MEKAVNDGSHSEELFCHLKTISEKEDLPRCTSESHLSWYSHQYQGKSKFPILGFPVLSII

SEQ ID NO: 60549 - protein, 243 aa, Homo sapiens
  Payload ID: 12118
  Gene Symbol: ODF2L
  Gene Name: outer dense fiber of sperm tails 2-like
  ENSP ID: ENSP00000432834
MLLENLTDNESENTNLKKKVFEKEAHIQELSCLFQSEKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQ

SEQ ID NO: 60550 - protein, 520 aa, Homo sapiens
  Payload ID: 12118
  Gene Symbol: ODF2L
  Gene Name: outer dense fiber of sperm tails 2-like
  ENSP ID: ENSP00000433092
TGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 60551 - protein, 43 aa, Homo sapiens
  Payload ID: 12118
  Gene Symbol: ODF2L
  Gene Name: outer dense fiber of sperm tails 2-like
  ENSP ID: ENSP00000433632
MEKAVNDGSHSEELFCHLKTISEKEDLPRCTSESHLSWRIFLH

SEQ ID NO: 60552 - protein, 153 aa, Homo sapiens
  Payload ID: 12118
  Gene Symbol: ODF2L
  Gene Name: outer dense fiber of sperm tails 2-like
  ENSP ID: ENSP00000437043
ILKQWEEYSVLAWVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNS

SEQ ID NO: 60553 - protein, 60 aa, Homo sapiens; identical to SEQ ID NO: 60548
  Payload ID: 12118
  Gene Symbol: ODF2L
  Gene Name: outer dense fiber of sperm tails 2-like
  ENSP ID: ENSP00000437292

SEQ ID NO: 60554 - protein, 254 aa, Homo sapiens
  Payload ID: 12119
  Gene Symbol: ODF3
  Gene Name: outer dense fiber of sperm tails 3
  Uniprot ID: Q96PU9
  ENSP ID: ENSP00000325868
MTEEVWMGTWRPHRPRGPIMALYSSPGPKYLIPPTTGFMKHTPTKLRAPAYSFRGAPMLLAENCSPGPRYNVNPKILRTGKDLGPAYSILGRYQTKTMLTPGPGDYFPEKSTKYVFDSAPSHSISARTKAFRVDSTPGPAAYMLPMVMGPNTVGKASQPSFSIKGRSKLGGFSDDLHKTPGPAAYRQTDVRVTKFKAPQYTMAARVEPPGDKTLKPGPGAHSPEKVTLTKPCAPVVTFGIKHSDYMTPLLVDVE

SEQ ID NO: 60555 - protein, 127 aa, Homo sapiens
  Payload ID: 12119
  Gene Symbol: ODF3
  Gene Name: outer dense fiber of sperm tails 3
  ENSP ID: ENSP00000339623
MTEEVWMGTWRPHRPRGPIMALYSSPGPKYLIPPTTGFMKHTPTKLRAPAYSFRGAPMLLAENCSPGPRYNTVGKASQPSFSIKGRSKLGGFSDDLHKVTLTKPCAPVVTFGIKHSDYMTPLLVDVE

SEQ ID NO: 60556 - protein, 207 aa, Homo sapiens
  Payload ID: 12119
  Gene Symbol: ODF3
  Gene Name: outer dense fiber of sperm tails 3
  Uniprot ID: Q96PU9
  ENSP ID: ENSP00000436588
MTEEVWMGTWRPHRPRGPIMALYSSPGPKYLIPPTTGFMKHTPTKLRAPAYSFRGAPMLLAENCSPGPRYNVNPKILRTGKDLGPAYSILGRYQTKTMLTPGPGDYFPEKSTKYVFDSAPSHSISARTKAFRVDSTPGPAAYMLPMVMGPNTVGKASQPSFSIKGRSKLGGFSDDLHKVTLTKPCAPVVTFGIKHSDYMTPLLVDVE

SEQ ID NO: 60557 - protein, 253 aa, Homo sapiens
  Payload ID: 12120
  Gene Symbol: ODF3B
  Gene Name: outer dense fiber of sperm tails 3B
  Uniprot ID: A8MYP8
  ENSP ID: ENSP00000382804
MGSDAWVGLWRPHRPRGPIAAHYGGPGPKYKLPPNTGYALHDPSRPRAPAFTFGARFPTQQTTCGPGPGHLVPARMTVRGTDGAPAYSIYGRPRRSAPFLTPGPGRYFPERAGNATYPSAPRHTIAPRNWGVQAEQQSPGPAAYTVPSLLGPRVIGKVSAPTCSIYGRRAAGSFFEDLSKTPGPCAYQVVSPGVYKSRAPQFTILARTSLPQDNTRKPGPAAYNVDQHRKPRGWSFGIRHSDYLAPLVTDADN

SEQ ID NO: 60558 - protein, 281 aa, Homo sapiens
  Payload ID: 12120
  Gene Symbol: ODF3B
  Gene Name: outer dense fiber of sperm tails 3B
  ENSP ID: ENSP00000384012
MGSDAWVGLWRPHRPRGPIAAHYGGPGPKYKLPPNTGYALHDPSRPRAPAFTFGARFPTQQTTCGPGPGHLVPARMTVRGTDGAPAYSIYGRPRRSAPFLTPGPGSHAVLAPHTLDPPRRQVLPGASGERDVPQCASAHHCSPKLGCPGGTAEPRSRGLYGALALGSARHRQSLRPNLLHLRPQSGWQFLRGPQQDPGPLRLSGRESRGLQVPGPPVHDSGADFAPPRQHSEARARGLQRGSAPEAPRLEFRDPALGLPGPAGDRRGQLTRQAGAAPHVFA

SEQ ID NO: 60559 - protein, 242 aa, Homo sapiens
  Payload ID: 12120
  Gene Symbol: ODF3B
  Gene Name: outer dense fiber of sperm tails 3B
  ENSP ID: ENSP00000384310
MGSDAWVGLWRPHRPRGPIAAHYGGPGPKYKLPPNTADDVRPRARPPGARSHDRARHRRRPRLLHLRPPTPLSALPHSGTWQVLPGASGERDVPQCASAHHCSPKLGCPGGTAEPRSRGLYGALALGSARHRQSLRPNLLHLRPQSGWQFLRGPQQDPGPLRLSGRESRGLQVPGPPVHDSGADFAPPRQHSEARARGLQRGSAPEAPRLEFRDPALGLPGPAGDRRGQLTRQAGAAPHVFA

SEQ ID NO: 60560 - protein, 185 aa, Homo sapiens
  Payload ID: 12120
  Gene Symbol: ODF3B
  Gene Name: outer dense fiber of sperm tails 3B
  ENSP ID: ENSP00000385123
MGSDAWVGLWRPHRPRGPIAAHYGGPGPKYKLPPNTGRYFPERAGNATYPSAPRHTIAPRNWGVQAEQQSPGPAAYTVPSLLGPRVIGKVSAPTCSIYGRRAAGSFFEDLSKTPGPCAYQVVSPGVYKSRAPQFTILARTSLPQDNTRKPGPAAYNVDQHRKPRGWSFGIRHSDYLAPLVTDADN

SEQ ID NO: 60561 - protein, 253 aa, Homo sapiens; identical to SEQ ID NO: 60557
  Payload ID: 12120
  Gene Symbol: ODF3B
  Gene Name: outer dense fiber of sperm tails 3B
  Uniprot ID: A8MYP8
  ENSP ID: ENSP00000390712

SEQ ID NO: 60562 - protein, 46 aa, Homo sapiens
  Payload ID: 12120
  Gene Symbol: ODF3B
  Gene Name: outer dense fiber of sperm tails 3B
  ENSP ID: ENSP00000393668
MGSDAWVGLWRPHRPRGPIAAHYGGPGPKYKLPPNTGYALHDPSRP

SEQ ID NO: 60563 - protein, 274 aa, Homo sapiens
  Payload ID: 12121
  Gene Symbol: ODF3L1
  Gene Name: outer dense fiber of sperm tails 3-like 1
  Uniprot ID: Q8IXM7
  ENSP ID: ENSP00000329584
MKLPKGTRSSVYFAQHPEKEPLPSRQEVKQTPVIMAKIKGPGPAKYLRPSCTGYIDHDISMFKAPAYTLHSRHSEKRMVCHSSPGPCYLLDPKITRFGMSSCPQVPMEERISNLRLNPTLASCQYYFEKIHPPGERRAPQYTFGYRRPYRVMDLNPAPNQYQMPLLLGPNTPVSRAAPCYSLASRDKNWFYKEDVAGGPGPTTYARPEPSIYQNRSPTYSMAKRFAYPLDLTPRPGPGSHEVQQVTVHKPHIPAFTMGIKHSLHLCPLVIDIRD

SEQ ID NO: 60564 - protein, 289 aa, Homo sapiens
  Payload ID: 12122
  Gene Symbol: ODF3L2
  Gene Name: outer dense fiber of sperm tails 3-like 2
  Uniprot ID: Q3SX64
  ENSP ID: ENSP00000318029
MGTLSCDSTPRLATAPLGRRVTEGQIPETGLRKSCGTATLENGSGPGLYVLPSTVGFINHDCTRVASPAYSLVRRPSEAPPQDTSPGPIYFLDPKVTRFGRSCTPAYSMQGRAKSRGPEVTPGPGAYSPEKVPPVRHRTPPAFTLGCRLPLKPLDTSAPAPNAYTMPPLWGSQIFTKPSSPSYTVVGRTPPARPPQDPAEIPGPGQYDSPDANTYRQRLPAFTMLGRPRAPRPLEETPGPGAHCPEQVTVNKARAPAFSMGIRHSKRASTMAATTPSRPAGHRLPGRCC

SEQ ID NO: 60565 - protein, 253 aa, Homo sapiens
  Payload ID: 12122
  Gene Symbol: ODF3L2
  Gene Name: outer dense fiber of sperm tails 3-like 2
  Uniprot ID: Q3SX64
  ENSP ID: ENSP00000372143
MGTLSCDSTPRLATAPLGRRVTEGQIPETGLRKSCGTATLENAPPQDTSPGPIYFLDPKVTRFGRSCTPAYSMQGRAKSRGPEVTPGPGAYSPEKVPPVRHRTPPAFTLGCRLPLKPLDTSAPAPNAYTMPPLWGSQIFTKPSSPSYTVVGRTPPARPPQDPAEIPGPGQYDSPDANTYRQRLPAFTMLGRPRAPRPLEETPGPGAHCPEQVTVNKARAPAFSMGIRHSKRASTMAATTPSRPAGHRLPGRCC

SEQ ID NO: 60566 - protein, 257 aa, Homo sapiens
  Payload ID: 12123
  Gene Symbol: ODF4
  Gene Name: outer dense fiber of sperm tails 4
  Uniprot ID: Q2M2E3
  ENSP ID: ENSP00000331086
MDAEYSGNEFPRSEGERDQHQRPGKERKSGEAGWGTGELGQDGRLLSSTLSLSSNRSLGQRQNSPLPFQWRITHSFRWMAQVLASELSLVAFILLLVVAFSKKWLDLSRSLFYQRWPVDVSNRIHTSAHVMSMGLLHFYKSRSCSDLENGKVTFIFSTLMLFPINIWIFELERNVSIPIGWSYFIGWLVLILYFTCAILCYFNHKSFWSLILSHPSGAVSCSSSFGSVEESPRAQTITDTPITQEGVLDPEQKDTHV

SEQ ID NO: 60567 - protein, 142 aa, Homo sapiens
  Payload ID: 12123
  Gene Symbol: ODF4
  Gene Name: outer dense fiber of sperm tails 4
  ENSP ID: ENSP00000461942
MDAEYSGNEFPRSEGERDQHQRPGKERKSGEAGWGTVTFIFSTLMLFPINIWIFELERNVSIPIGWSYFIGWLVLILYFTCAILCYFNHKSFWSLILSHPSGAVSCSSSFGSVEESPRAQTITDTPITQEGVLDPEQKDTHV

SEQ ID NO: 60568 - protein, 227 aa, Homo sapiens
  Payload ID: 12124
  Gene Symbol: OVCA2
  Gene Name: ovarian tumor suppressor candidate 2
  Uniprot ID: Q8WZ82
  ENSP ID: ENSP00000461388
MAAQRPLRVLCLAGFRQSERGFREKTGALRKALRGRAELVCLSGPHPVPDPPGPEGARSDFGSCPPEEQPRGWWFSEQEADVFSALEEPAVCRGLEESLGMVAQALNRLGPFDGLLGFSQGAALAALVCALGQAGDPRFPLPRFILLVSGFCPRGIGFKESILQRPLSLPSLHVFGDTDKVIPSQESVQLASQFPGAITLTHSGGHFIPAAAPQRQAYLKFLDQFAE

SEQ ID NO: 60569 - protein, 678 aa, Homo sapiens
  Payload ID: 12125
  Gene Symbol: OVGP1
  Gene Name: oviductal glycoprotein 1, 120kDa
  Uniprot ID: Q12889
  ENSP ID: ENSP00000358747
MWKLLLWVGLVLVLKHHDGAAHKLVCYFTNWAHSRPGPASILPHDLDPFLCTHLIFAFASMNNNQIVAKDLQDEKILYPEFNKLKERNRELKTLLSIGGWNFGTSRFTTMLSTFANREKFIASVISLLRTHDFDGLDLFFLYPGLRGSPMHDRWTFLFLIEELLFAFRKEALLTMRPRLLLSAAVSGVPHIVQTSYDVRFLGRLLDFINVLSYDLHGSWERFTGHNSPLFSLPEDPKSSAYAMNYWRKLGAPSEKLIMGIPTYGRTFRLLKASKNGLQARAIGPASPGKYTKQEGFLAYFEICSFVWGAKKHWIDYQYVPYANKGKEWVGYDNAISFSYKAWFIRREHFGGAMVWTLDMDDVRGTFCGTGPFPLVYVLNDILVRAEFSSTSLPQFWLSSAVNSSSTDPERLAVTTAWTTDSKILPPGGEAGVTEIHGKCENMTITPRGTTVTPTKETVSLGKHTVALGEKTEITGAMTMTSVGHQSMTPGEKALTPVGHQSVTTGQKTLTSVGYQSVTPGEKTLTPVGHQSVTPVSHQSVSPGGTTMTPVHFQTETLRQNTVAPRRKAVAREKVTVPSRNISVTPEGQTMPLRGENLTSEVGTHPRMGNLGLQMEAENRMMLSSSPVIQLPEQTPLAFDNRFVPIYGNHSSVNSVTPQTSPLSLKKEIPENSAVDEEA

SEQ ID NO: 60570 - protein, 1134 aa, Homo sapiens
  Payload ID: 12126
  Gene Symbol: OVCH1
  Gene Name: ovochymase 1
  Uniprot ID: Q7RTY7
  ENSP ID: ENSP00000326708
MGLLASAGLLLLLVIGHPRSLGLKCGIRMVNMKSKEPAVGSRFFSRISSWRNSTVTGHPWQVSLKSDEHHFCGGSLIQEDRVVTAAHCLDSLSEKQLKNITVTSGEYSLFQKDKQEQNIPVSKIITHPEYNSREYMSPDIALLYLKHKVKFGNAVQPICLPDSDDKVEPGILCLSSGWGKISKTSEYSNVLQEMELPIMDDRACNTVLKSMNLPPLGRTMLCAGFPDWGMDACQGDSGGPLVCRRGGGIWILAGITSWVAGCAGGSVPVRNNHVKASLGIFSKVSELMDFITQNLFTGLDRGQPLSKVGSRYITKALSSVQEVNGSQRGKGILDMEKQVGCDHDYVSLRSSSGVLFNQRSLMEDDGKQNKRVCGKILPSPLLAETSEAMVPFVSDTEDSGSGFELTVTAVQKSEAGSGCGSLAILVEEGTNHSAKYPDLYPSNTRCHWFICAPEKHIIKLTFEDFAVKFSPNCIYDAVVIYGDSEEKHKLAKLCGMLTITSIFSSSNMTVIYFKSDGKNRLQGFKARFTILPSESLNKFEPKLPPQNNPVSTVKAILHDVCGIPPFSPQWLSRRIAGGEEACPHCWPWQVGLRFLGDYQCGGAIINPVWILTAAHCVQLKNNPLSWTIIAGDHDRNLKESTEQVRRAKHIIVHEDFNTLSYDSDIALIQLSSPLEYNSVVRPVCLPHSAEPLFSSEICAVTGWGSISADGGLASRLQQIQVHVLEREVCEHTYYSAHPGGITEKMICAGFAASGEKDFCQGDSGGPLVCRHENGPFVLYGIVSWGAGCVQPWKPGVFARVMIFLDWIQSKINGPASLQTNNKCKTLKQQLPPPTPSPDSASWPGCCSEAELEKPRGFFPTPRYLLDYRGRLECSWVLRVSASSMAKFTIEYLSLLGSPVCQDSVLIIYEERHSKRKTAGGLHGRRLYSMTFMSPGPLVRVTFHALVRGAFGISYIVLKVLGPKDSKITRLSQSSNREHLVPCEDVLLTKPEGIMQIPRNSHRTTMGCQWRLVAPLNHIIQLNIINFPMKPTTFVCHGHLRVYEGFGPGKKLIASFAGTLAMILTKDILKREKLNFINTYIMHIWENSVYDNVRSVGKRKQKKFASNLSYSMEAEKSRIQVPADLVPAKGSLSGS

SEQ ID NO: 60571 - protein, 121 aa, Homo sapiens
  Payload ID: 12126
  Gene Symbol: OVCH1
  Gene Name: ovochymase 1
  ENSP ID: ENSP00000445260
  MOD_RES (1)..(1): Any amino acid
XKITRLSQSSNREHLVPCEDVLLTKPEGIMQIPRNSHRTTMGCQWRLVAPLNHIIQLNIINFPMKPTTFVCHGHLRVYEGFGPGKKLIAHLHGSKKEFILISSAAYLTVHFKTDESERKRF

SEQ ID NO: 60572 - protein, 80 aa, Homo sapiens
  Payload ID: 12126
  Gene Symbol: OVCH1
  Gene Name: ovochymase 1
  ENSP ID: ENSP00000445480
REHLVPCEDVLLTKPEGIMQIPRNSHRTTMGCQWRLVAPLNHIIQLNIINFPMKPTTFVCHGHLRVYEGFGPGKKLIGEC

SEQ ID NO: 60573 - protein, 565 aa, Homo sapiens
  Payload ID: 12127
  Gene Symbol: OVCH2
  Gene Name: ovochymase 2 (gene/pseudogene)
  ENSP ID: ENSP00000484497
MLISRNKLILLLGIVFFERGKSATLSLPKAPSCGQSLVKVQPWNYFNIFSRILGGSQVEKGSYPWQVSLKQRQKHICGGSIVSPQWVITAAHCIANRNIVSTLNVTAGEYDLSQTDPGEQTLTIETVIIHPHFSTKKPMDYDIALLKMAGAFQFGHFVGPICLPELREQFEAGFICTTAGWGRLTEGGVLSQVLQEVNLPILTWEECVAALLTLKRPISGKTFLCTGFPDGGRDACQGDSGGSLMCRNKKGAWTLAGVTSWGLGCGRGWRNNVRKSDQGSPGIFTDISKVLPWIHEHIQTGNRRKSSRAWCSEQDVIVSGAEGKLHFPESLHLYYESKQRCVWTLLVPEEMHVLLSFSHLDVESCHHSYLSMYSLEDRPIGKFCGESLPSSILIGSNSLRLKFVSDATDNAAGFNLTYKALKPNYIPDSGCSYLTVLFEEGLIQSLNYPENYSDKANCDWIFQASKHHLIKLSFQSLEIEESGDCTSDYVTVHSDVERKKEIARLCGYDVPTPVLSPSSIMLISFQSDENGTCRGFQATVSFIPKAVYPDLNISISEDESMFLET

SEQ ID NO: 60574 - protein, 565 aa, Homo sapiens; identical to SEQ ID NO: 60573
  Payload ID: 12127
  Gene Symbol: OVCH2
  Gene Name: ovochymase 2 (gene/pseudogene)
  ENSP ID: ENSP00000484790

SEQ ID NO: 60575 - protein, 267 aa, Homo sapiens
  Payload ID: 12128
  Gene Symbol: OVOL1
  Gene Name: ovo-like zinc finger 1
  Uniprot ID: O14753
  ENSP ID: ENSP00000337862
MPRAFLVKKPCVSTCKRNWSELPDEERGEIYVPVSLGFCPPQPYREPEPSVAEPPSCPLALNMSLRDSSYSMAPGPCVVAQLPSEDMGHLTDPQSRDHGFLRTKMKVTLGDSPSGDLFTCRVCQKAFTYQRMLNRHMKCHNDVKRHLCTYCGKGFNDTFDLKRHVRTHTGVRPYKCSLCDKAFTQRCSLESHLKKIHGVQQKYAYKERRAKLYVCEECGCTSESQEGHVLHLKEHHPDSPLLRKTSKKVAVALQNTVTSLLQGSPHL

SEQ ID NO: 60576 - protein, 205 aa, Homo sapiens
  Payload ID: 12128
  Gene Symbol: OVOL1
  Gene Name: ovo-like zinc finger 1
  ENSP ID: ENSP00000434220
MSLRDSSYSMAPGPCVVAQLPSEDMGHLTDPQSRDHGFLRTKMKVTLGDSPSGDLFTCRVCQKAFTYQRMLNRHMKCHNDVKRHLCTYCGKGFNDTFDLKRHVRTHTGVRPYKCSLCDKAFTQRCSLESHLKKIHGVQQKYAYKERRAKLYVCEECGCTSESQEGHVLHLKEHHPDSPLLRKTSKKVAVALQNTVTSLLQGSPHL

SEQ ID NO: 60577 - protein, 275 aa, Homo sapiens
  Payload ID: 12129
  Gene Symbol: OVOL2
  Gene Name: ovo-like zinc finger 2
  Uniprot ID: Q9BRP0
  ENSP ID: ENSP00000278780
MPKVFLVKRRSLGVSVRSWDELPDEKRADTYIPVGLGRLLHDPPEDCRSDGGSSSGSGSSSAGEPGGAESSSSPHAPESETPEPGDAEGPDGHLATKQRPVARSKIKFTTGTCSDSVVHSCDLCGKGFRLQRMLNRHLKCHNQVKRHLCTFCGKGFNDTFDLKRHVRTHTGIRPYKCNVCNKAFTQRCSLESHLKKIHGVQQQYAYKQRRDKLYVCEDCGYTGPTQEDLYLHVNSAHPGSSFLKKTSKKLAALLQGKLTSAHQENTSLSEEEERK

SEQ ID NO: 60578 - protein, 214 aa, Homo sapiens
  Payload ID: 12130
  Gene Symbol: OVOL3
  Gene Name: ovo-like zinc finger 3
  Uniprot ID: O00110
  ENSP ID: ENSP00000465620
MPRAFLVRSRRPQPPNWGHLPDQLRGDAYIPGGPLTVPGGKGQERRSVTIWLFSSDCSSLGGPPAQQSSSVRDPWTAQPTQGNLTSAPRGPGTLGCPLCPKAFPLQRMLTRHLKCHSPVRRHLCRCCGKGFHDAFDLKRHMRTHTGIRPFRCSACGKAFTQRCSLEAHLAKVHGQPASYAYRERREKLHVCEDCGFTSSRPDTYAQHRALHRAA

SEQ ID NO: 60579 - protein, 190 aa, Homo sapiens
  Payload ID: 12130
  Gene Symbol: OVOL3
  Gene Name: ovo-like zinc finger 3
  ENSP ID: ENSP00000487603
MPRAFLVRSRRPQPPNWGHLPDQLRGDAYIPDCSSLGGPPAQQSSSVRDPWTAQPTQGNLTSAPRGPGTLGCPLCPKAFPLQRMLTRHLKCHSPVRRHLCRCCGKGFHDAFDLKRHMRTHTGIRPFRCSACGKAFTQRCSLEAHLAKVHGQPASYAYRERREKLHVCEDCGFTSSRPDTYAQHRALHRAA

SEQ ID NO: 60580 - protein, 1433 aa, Homo sapiens
  Payload ID: 12131
  Gene Symbol:
  Gene Name: OVOS2
  ENSP ID: ENSP00000479893
MTGSHLSHDSWQYVLLIPSVLQEGSLDKACAQLFNLTESVVLTVSLNYGEVQTKIFEENVTGENFFKCISFEVPQARSDPLAFITFSAKGATLNLEERRSVAIRSRENVVFVQTDKPTYKPGQKDVNGIAQFFLDTYTFTYPNITLKDPQNNRIFQWQNVTSFRNITQLSFQLISEPMFGDYWIVVKRNSRKTVTHQFAVKRYVLPKFEVTVNAPQTVTISDDEFQVDVCAKYTFGQPVQGKTQIRVCREYFSSSNCEKNDNEICEQFIAQLENGCVSQIVNTKVFQLYRSGLFMTFHVAVIVTEFGTGNYCMQISEKTSVFITQLLGTVNFENMDTFYRRGISYFGTLKFSDPNNVPMVNKLLQLELNDEFIGNYTTDENGEAQFSIDTSDIFDPEFNLKATYVRPKSCYLPSWLTPQYLDAHFLVSRFYSRTNSFLKIVPEPKQLECNHQKVVTVHYSLNSEAYEDDSNVKFFYLVSLSHDSGNFQHRISSSPIYTAWNGNFSFPLSISADLAPAAVLFVYTLHPSGEIVADSVRFQVDKCFKHKVNIKFSNEQGLPGSNASLYLQAAPVLFCALGAVDGNVLLLKSEQQLSAESVYNMVPSIEPYGYFYHGLNLDDGKEDPCIPQRDMFYNGLYYTPVSNYGDGDIYNIVRNMGLKVFTNLHYRKPEVCVMERRLPLPKPLYLETENYGPMHSVPSRIACRGENADYVEQAIIQTVRTNFPETWMWDLVSVDSSGSANLSFLIPDTITQWEASGFCVNGDVGFGISSTTTLEVSQPFFIEIASPFSVVQNEQFDLIVNAFSYLNTCVEISVQVEESQNYEANINTWKINGSEVIQAGGRKTNIWTIIPKKLGKVNITVVAESKQSSACPNEGMEQQKLNWKDTVVKSFLVEPEGIEKERTQSFLICTEGAKASKQGVLDLPNDVVEGSARGFFTVVGDILGLAMQNLVVLQMPYGGGEQNAALLASDTYVLDYLKSTEQLTEEVQSKAFFLLSNGYQRQLSFKNSDGSYSVFWQQNQKGSIWLSALTFKTLERMKKFVFIDENVQKQTLIWLSSQQKTSGCFKNDGQLFNHAWEGGDEEDISLTAYVVGMFFEAGLNSTFPALRNALFCLEAALDSGVTNGYNHAILAYAFALAGKEKQVESLLQTLDQSATKLNNVIYWERERKPKTEEFPSFIPWAPSAQTEKSCYVLLAVISRKIPDLTYASKIVQWLAQQMNSHGGFSSNQVINVGLILIAILGEEGLFSKNQNTVTFSSEGSSEIFQVNGHNRLLVQRSEVTQAPGQYTVDVEGRGCTFIQATLKYNVLLPKKASGFSLSLEIVKNYSLTVFDLTVNLKYTGIRNKSSMVVIDVKMLSGFTPTMSSIEELENKGQVMKTEVKNDHVLFYLENVFGRADSFTFSVEQSNLVFNIQPAPGMVYDYYEKDGEAFLLTN

SEQ ID NO: 60581 - protein, 1432 aa, Homo sapiens
  Payload ID: 12131
  Gene Symbol:
  Gene Name: OVOS2
  ENSP ID: ENSP00000487815
MTGSHLSHDSWQYVLLIPSVLQEGSLDKACAQLFNLTESVVLTVSLNYGEVQTKIFEENVTGENFFKCISFEVPQARSDPLAFITFSAKGATLNLEERRSVAIRSRENVVFVQTDKPTYKPGQKDVNGIAQFFLDTYTFTYPNITLKDPQNNRIFQWQNVTSFRNITQLSFQLISEPMFGDYWIVVKRNSRKTVTHQFAVKRYVLPKFEVTVNAPQTVTISDDEFQVDVCAKYTFGQPVQGKTQIRVCREYFSSSNCEKNDNEICEQFIAQLENGCVSQIVNTKVFQLYRSGLFMTFHVAVIVTEFGTGNYCMQISEKTSVFITQLLGTVNFENMDTFYRRGISYFGTLKFSDPNNVPMVNKLLQLELNDEFIGNYTTDENGEAQFSIDTSDIFDPEFNLKATYVRPKSCYLPSWLTPQYLDAHFLVSRFYSRTNSFLKIVPEPKQLECNHQKVVTVHYSLNSEAYEDDSNVKFFYLVSLSHDSGNFQHRISSSPIYTAWNGNFSFPLSISADLAPAAVLFVYTLHPSGEIVADSVRFQVDKCFKHKVNIKFSNEQGLPGSNASLYLQAAPVLFCALGAVDGNVLLLKSEQQLSAESVYNMVPSIEPYGYFYHGLNLDDGKEDPCIPQRDMFYNGLYYTPVSNYGDGDIYNIVRNMGLKVFTNLHYRKPEVCVMERRLPLPKPLYLETENYGPMHSVPSRIACRGENADYVEQAIIQTVRTNFPETWMWDLVSVDSSGSANLSFLIPDTITQWEASGFCVNGDVGFGISSTTTLEVSQPFFIEIASPFSVVQNEQFDLIVNAFSYLNTCVEISVQVEESQNYEANINTWKINGSEVIQAGGRKTNIWTIIPKKLGKVNITVVAESKQSSACPNEGMEQQKLNWKDTVVKSFLVEPEGIEKERTQSFLICTEGAKASKQGVLDLPNDVVEGSARGFFTVVGDILGLAMQNLVVLQMPYGGGEQNAALLASDTYVLDYLKSTEQLTEEVQSKAFFLLSNGYQRQLSFKNSDGSYSVFWQQNQKGSIWLSALTFKTLERMKKFVFIDENVQKQTLIWLSSQQKTSGCFKNDGQLFNHAWEGGDEEDISLTAYVVGMFFEAGLNSTFPALRNALFCLEAALDSGVTNGYNHAILAYAFALAGKEKQVESLLQTLDQSATKLNNVIYWERERKPKTEEFPSFIPWAPSAQTEKSCYVLLAVISRKIPDLTYASKIVQWLAQQMNSHGGFSSNQVINVGLILIAICGEEGLFSKNQNTVTFSSEGSSEIQFNGHNRLLVQRSEVTQAPGQYTVDVEGRGCTFIQATLKYNVLLPKKASGFSLSLEIVKNYSLTVFDLTVNLKYTGIRNKSSMVVIDVKMLSGFTPTMSSIEELENKGQVMKTEVKNDHVLFYLENVFGRADSFTFSAEQSNLVFNIQPAPGMVYDYYWKGGEAFLLTN

SEQ ID NO: 60582 - protein, 1419 aa, Homo sapiens
  Payload ID: 12131
  Gene Symbol:
  Gene Name: OVOS2
  ENSP ID: ENSP00000488166
MTGSHLSHDSWQYVLLIPSVLQEGSLDKACAQLFNLTESVVLTVSLNYGEVQTKIFEENVTGENFFKCISFEVPQARSDPLAFITFSAKGATLNLEERRSVAIRSRENVVFVQTDKPTYKPGQKDVNGIAQFFLDTYTFTYPNITLKDPQNNRIFQWQNVTSFRNITQLSFQLISEPMFGDYWIVVKRNSRKTVTHQFAVKRYVLPKFEVTVNAPQTVTISDDEFQVDVCAKYTFGQPVQGKTQIRVCREYFSSSNCEKNDNEICEQFIAQLENGCVSQIVNTKVFQLYRSGLFMTFHVAVIVTEFGTGNYCMQISEKTSVFITQLLGTVNFENMDTFYRRGISYFGTLKFSDPNNVPMVNKLLQLELNDEFIGNYTTDENGEAQFSIDTSDIFDPEFNLKATYVRPKSCYLPSWLTPQYLDAHFLVSRFYSRTNSFLKIVPEPKQLECNHQKVVTVHYSLNSEAYEDDSNVKFFYLVSLSHDSGNFQHRISSSPIYTAWNGNFSFPLSISADLAPAAVLFVYTLHPSGEIVADSVRFQVDKCFKHKVNIKFSNEQGLPGSNASLYLQAAPVLFCALGAVDGNVLLLKSEQQLSAESVYNMVPSIEPYGYFYHGLNLDDGKEDPCIPQRDMFYNGLYYTPVSNYGDGDIYNIVRNMGLKVFTNLHYRKPEVCVMERRLPLPKPLYLETENYGPMHSVPSRIACRGENADYVEQAIIQTVRTNFPETWMWDLVSVDSSGSANLSFLIPDTITQWEASGFCVNGDVGFGISSTTTLEVSQPFFIEIASPFSVVQNEQFDLIVNAFSYLNTCVEISVQVEESQNYEANINTWKINGSEVIQAGGRKTNIWTIIPKKLGKVNITVVAESKQSSACPNEGMEQQKLNWKDTVVKSFLVEPEGIEKERTQSFLICTEGAKASKQGVLDLPNDVVEGSARGFFTVVGDILGLAMQNLVVLQMPYGGGEQNAALLASDTYVLDYLKSTEQLTEEVQSKAFFLLSNGYQRQLSFKNSDGSYSVFWQQNQKGSIWLSALTFKTLERMKKFVFIDENVQKQTLIWLSSQQKTSGCFKNDGQLFNHAWEGGDEEDISLTAYVVGMFFEAGLNSTFPALRNALFCLEAALDSGVTNGYNHAILAYAFALAGKEKQVESLLQTLDQSATKLNNVIYWERERKPKTEEFPSFIPWAPSAQTEKSCYVLLAVISRKIPDLTYASKIVQWLAQQMNSHGGFSSNQVINVGLILIAICGEEGLFSKNQNTVTFSSEGSSEIQFNGHNRLLVQRSEVTQAPGQYTVDVEGRGCTFIQATLKYNVLLPKKASGFSLSLEIVKNYSLTVFDLTVNLKYTGIRNKSSMVVIDVKMLSGFTPTMSSIEELENKGQVMKTEVKNDHVLFYLENVFGRADSFTFSAEQSNLVFNIQPAPGMVYD

SEQ ID NO: 60583 - protein, 495 aa, Homo sapiens
  Payload ID: 12132
  Gene Symbol: OXA1L
  Gene Name: oxidase (cytochrome c) assembly 1-like
  ENSP ID: ENSP00000285848
MVTWLYRFLPTSNMAAKLRSLLPPDLRLQFWLHARLQKCFLSRGCGSYCAGAKASPLPGKMAMGLMCGRRELLRLLQSGRRVHSVAGPSQWLGKPLTTRLLFPAAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSKPKSKYPWHDTLG

SEQ ID NO: 60584 - protein, 419 aa, Homo sapiens
  Payload ID: 12132
  Gene Symbol: OXA1L
  Gene Name: oxidase (cytochrome c) assembly 1-like
  Uniprot ID: Q15070
  ENSP ID: ENSP00000350740
MRGTQVHSVAGPSQWLGKPLTTRLLFPAAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSKPKSKYPWHDTLG

SEQ ID NO: 60585 - protein, 408 aa, Homo sapiens
  Payload ID: 12132
  Gene Symbol: OXA1L
  Gene Name: oxidase (cytochrome c) assembly 1-like
  ENSP ID: ENSP00000387601
MAMGLMCGRRELLRLLQSGRRVHSVAGPSQWLGKPLTTRLLFPAAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGPLRQTFTHNPLLQPGKDNPPNIPSSSSKPKSKYPWHDTLG

SEQ ID NO: 60586 - protein, 82 aa, Homo sapiens
  Payload ID: 12132
  Gene Symbol: OXA1L
  Gene Name: oxidase (cytochrome c) assembly 1-like
  ENSP ID: ENSP00000389240
LPGKMAMGLMCGRRELLRLLQSGRRPRAAVAHTTSSLRLPAPAASVPLLSLLQKSRFRPLLLLLQLPHPQQYLRWLLERLQM

SEQ ID NO: 60587 - protein, 112 aa, Homo sapiens
  Payload ID: 12132
  Gene Symbol: OXA1L
  Gene Name: oxidase (cytochrome c) assembly 1-like
  ENSP ID: ENSP00000396596
MHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVP

SEQ ID NO: 60588 - protein, 435 aa, Homo sapiens
  Payload ID: 12132
  Gene Symbol: OXA1L
  Gene Name: oxidase (cytochrome c) assembly 1-like
  ENSP ID: ENSP00000474623
MAMGLMCGRRELLRLLQSGRRVHSVAGPSQWLGKPLTTRLLFPAAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSKPKSKYPWHDTLG

SEQ ID NO: 60589 - protein, 495 aa, Homo sapiens; identical to SEQ ID NO: 60583
  Payload ID: 12132
  Gene Symbol: OXA1L
  Gene Name: oxidase (cytochrome c) assembly 1-like
  ENSP ID: ENSP00000483491

SEQ ID NO: 60590 - protein, 243 aa, Homo sapiens
  Payload ID: 12133
  Gene Symbol: OXR1
  Gene Name: oxidation resistance 1
  Uniprot ID: Q8N573
  ENSP ID: ENSP00000297447
MSRLWYGKKGRRHQPINHKYTLVVSVAEYHRRIDALNTEELRTLCRRLQITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 60591 - protein, 839 aa, Homo sapiens
  Payload ID: 12133
  Gene Symbol: OXR1
  Gene Name: oxidation resistance 1
  Uniprot ID: Q8N573
  ENSP ID: ENSP00000311026
MDYLTTFTEKSGRLLRGTANRLLGFGGGGEARQVRFEDYLREPAQGDLGCGSPPHRPPAPSSPEGPDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 60592 - protein, 87 aa, Homo sapiens
  Payload ID: 12133
  Gene Symbol: OXR1
  Gene Name: oxidation resistance 1
  ENSP ID: ENSP00000387886
MDYLTTFTEKSGRLLRGTANRLLGFGGGGEARQVRFEDYLREPAQGDLGCGSPPHRPPAPSSPEGPDYYKGRHKFKAGCYSESRPGV

SEQ ID NO: 60593 - protein, 873 aa, Homo sapiens
  Payload ID: 12133
  Gene Symbol: OXR1
  Gene Name: oxidation resistance 1
  Uniprot ID: Q8N573
  ENSP ID: ENSP00000395032
MSVSNLSWLKKKSQSVDINAPGFNPLAGAGKQTPQASKPPAPKTPIIEEEQNNAANTQKHPSRRSELKRFYTIDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEVVSVAEYHRRIDALNTEELRTLCRRLQITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 60594 - protein, 846 aa, Homo sapiens
  Payload ID: 12133
  Gene Symbol: OXR1
  Gene Name: oxidation resistance 1
  Uniprot ID: Q8N573
  ENSP ID: ENSP00000402918
MSVSNLSWLKKKSQSVDINAPGFNPLAGAGKQTPQASKPPAPKTPIIEEEQNNAANTQKHPSRRSELKRFYTIDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 60595 - protein, 874 aa, Homo sapiens
  Payload ID: 12133
  Gene Symbol: OXR1
  Gene Name: oxidation resistance 1
  Uniprot ID: Q8N573
  ENSP ID: ENSP00000405424
MTKDKNSPGLKKKSQSVDINAPGFNPLAGAGKQTPQASKPPAPKTPIIEEEQNNAANTQKHPSRRSELKRFYTIDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEVVSVAEYHRRIDALNTEELRTLCRRLQITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 60596 - protein, 216 aa, Homo sapiens
  Payload ID: 12133
  Gene Symbol: OXR1
  Gene Name: oxidation resistance 1
  Uniprot ID: Q8N573
  ENSP ID: ENSP00000408659
MSRLWYGKKGRRHQPINHKYTLITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 60597 - protein, 40 aa, Homo sapiens
  Payload ID: 12133
  Gene Symbol: OXR1
  Gene Name: oxidation resistance 1
  ENSP ID: ENSP00000414992
MDYLTTFTEKSGRLLRGTANRLLGFGGGGEARQTLAKRRP

SEQ ID NO: 60598 - protein, 873 aa, Homo sapiens; identical to SEQ ID NO: 60593
  Payload ID: 12133
  Gene Symbol: OXR1
  Gene Name: oxidation resistance 1
  Uniprot ID: Q8N573
  ENSP ID: ENSP00000429205

SEQ ID NO: 60599 - protein, 99 aa, Homo sapiens
  Payload ID: 12133
  Gene Symbol: OXR1
  Gene Name: oxidation resistance 1
  ENSP ID: ENSP00000429438
MKLRNTGQKKTLDKKDGRRMSFQKPKGTIEYTVESRDSLNSIALKFDTTPNELVQLNKLFSRAVVTGQVLYVPDPEYVSSVESSPSLSPVSPLSPTSSE

SEQ ID NO: 60600 - protein, 518 aa, Homo sapiens
  Payload ID: 12133
  Gene Symbol: OXR1
  Gene Name: oxidation resistance 1
  ENSP ID: ENSP00000430701
  MOD_RES (1)..(1): Any amino acid
XDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWELTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 60601 - protein, 503 aa, Homo sapiens
  Payload ID: 12133
  Gene Symbol: OXR1
  Gene Name: oxidation resistance 1
  Uniprot ID: Q8N573
  ENSP ID: ENSP00000431014
MFCQRKDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESKCYRVNEVSSSNCMVSPSFLTDSKAAVP

SEQ ID NO: 60602 - protein, 846 aa, Homo sapiens; identical to SEQ ID NO: 60594
  Payload ID: 12133
  Gene Symbol: OXR1
  Gene Name: oxidation resistance 1
  Uniprot ID: Q8N573
  ENSP ID: ENSP00000431966

SEQ ID NO: 60603 - protein, 119 aa, Homo sapiens
  Payload ID: 12133
  Gene Symbol: OXR1
  Gene Name: oxidation resistance 1
  ENSP ID: ENSP00000435104
MTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 60604 - protein, 560 aa, Homo sapiens
  Payload ID: 12134
  Gene Symbol: OSGIN1
  Gene Name: oxidative stress induced growth inhibitor 1
  Uniprot ID: Q9UJX0
  ENSP ID: ENSP00000343376
MGKWRPRGCCRGNMQCRQEVPATLTSSELFSTRNQPQPQPQPLLADAPVPWAVASRMCLTPGQGCGHQGQDEGPLPAPSPPPAMSSSRKDHLGASSSEPLPVIIVGNGPSGICLSYLLSGYTPYTKPDAIHPHPLLQRKLTEAPGVSILDQDLDYLSEGLEGRSQSPVALLFDALLRPDTDFGGNMKSVLTWKHRKEHAIPHVVLGRNLPGGAWHSIEGSMVILSQGQWMGLPDLEVKDWMQKKRRGLRNSRATAGDIAHYYRDYVVKKGLGHNFVSGAVVTAVEWGTPDPSSCGAQDSSPLFQVSGFLTRNQAQQPFSLWARNVVLATGTFDSPARLGIPGEALPFIHHELSALEAATRVGAVTPASDPVLIIGAGLSAADAVLYARHYNIPVIHAFRRAVDDPGLVFNQLPKMLYPEYHKVHQMMREQSILSPSPYEGYRSLPRHQLLCFKEDCQAVFQDLEGVEKVFGVSLVLVLIGSHPDLSFLPGAGADFAVDPDQPLSAKRNPIDVDPFTYQSTRQEGLYAMGPLAGDNFVRFVQGGALAVASSLLRKETRKPP

SEQ ID NO: 60605 - protein, 477 aa, Homo sapiens
  Payload ID: 12134
  Gene Symbol: OSGIN1
  Gene Name: oxidative stress induced growth inhibitor 1
  Uniprot ID: Q9UJX0
  ENSP ID: ENSP00000355374
MSSSRKDHLGASSSEPLPVIIVGNGPSGICLSYLLSGYTPYTKPDAIHPHPLLQRKLTEAPGVSILDQDLDYLSEGLEGRSQSPVALLFDALLRPDTDFGGNMKSVLTWKHRKEHAIPHVVLGRNLPGGAWHSIEGSMVILSQGQWMGLPDLEVKDWMQKKRRGLRNSRATAGDIAHYYRDYVVKKGLGHNFVSGAVVTAVEWGTPDPSSCGAQDSSPLFQVSGFLTRNQAQQPFSLWARNVVLATGTFDSPARLGIPGEALPFIHHELSALEAATRVGAVTPASDPVLIIGAGLSAADAVLYARHYNIPVIHAFRRAVDDPGLVFNQLPKMLYPEYHKVHQMMREQSILSPSPYEGYRSLPRHQLLCFKEDCQAVFQDLEGVEKVFGVSLVLVLIGSHPDLSFLPGAGADFAVDPDQPLSAKRNPIDVDPFTYQSTRQEGLYAMGPLAGDNFVRFVQGGALAVASSLLRKETRKPP

SEQ ID NO: 60606 - protein, 477 aa, Homo sapiens; identical to SEQ ID NO: 60605
  Payload ID: 12134
  Gene Symbol: OSGIN1
  Gene Name: oxidative stress induced growth inhibitor 1
  Uniprot ID: Q9UJX0
  ENSP ID: ENSP00000376983

SEQ ID NO: 60607 - protein, 105 aa, Homo sapiens
  Payload ID: 12134
  Gene Symbol: OSGIN1
  Gene Name: oxidative stress induced growth inhibitor 1
  ENSP ID: ENSP00000456965
MALKSTSIGLCLSQAFEEQLSNSVTDNHLTVYTFKTTGKPQTRHRGMGKWRPRGCCRGNMQCRQEGNGCPDLAGDSVIRVPLTLLVHNLAGLTGLLHHCLSGPLP

SEQ ID NO: 60608 - protein, 122 aa, Homo sapiens
  Payload ID: 12134
  Gene Symbol: OSGIN1
  Gene Name: oxidative stress induced growth inhibitor 1
  ENSP ID: ENSP00000457157
MSSSRKDHLGASSSEPLPVIIVGNGPSGICLSYLLSGYTPYTKPDAIHPHPLLQRKLTEAPGVSILDQDLDYLSEGLEGRSQSPVALLFDALLRPDTDFGGNMKSVLTWKHRKEHAIPHVVL

SEQ ID NO: 60609 - protein, 163 aa, Homo sapiens
  Payload ID: 12134
  Gene Symbol: OSGIN1
  Gene Name: oxidative stress induced growth inhibitor 1
  ENSP ID: ENSP00000462048
MSSSRKDHLGASSSEPLPVIIVGNGPSGICLSYLLSGYTPYTKPDAIHPHPLLQRKLTEAPGVSILDQDLDYLSEGLEGRSQSPVALLFDALLRPDTDFGGNMKSVLTWKHRKEHAIPHVVLGRNLPGGAWHSIEGSMVILSQGQWMGLPDLEVKDWMQKKRR

SEQ ID NO: 60610 - protein, 505 aa, Homo sapiens
  Payload ID: 12135
  Gene Symbol: OSGIN2
  Gene Name: oxidative stress induced growth inhibitor family member 2
  Uniprot ID: Q9Y236
  ENSP ID: ENSP00000297438
MPLVEETSLLEDSSVTFPVVIIGNGPSGICLSYMLSGYRPYLSSEAIHPNTILNSKLEEARHLSIVDQDLEYLSEGLEGRSSNPVAVLFDTLLHPDADFGYDYPSVLHWKLEQHHYIPHVVLGKGPPGGAWHNMEGSMLTISFGSWMELPGLKFKDWVSSKRRSLKGDRVMPEEIARYYKHYVKVMGLQKNFRENTYITSVSRLYRDQDDDDIQDRDISTKHLQIEKSNFIKRNWEIRGYQRIADGSHVPFCLFAENVALATGTLDSPAHLEIEGEDFPFVFHSMPEFGAAINKGKLRGKVDPVLIVGSGLTAADAVLCAYNSNIPVIHVFRRRVTDPSLIFKQLPKKLYPEYHKVYHMMCTQSYSVDSNLLSDYTSFPEHRVLSFKSDMKCVLQSVSGLKKIFKLSAAVVLIGSHPNLSFLKDQGCYLGHKSSQPITCKGNPVEIDTYTYECIKEANLFALGPLVGDNFVRFLKGGALGVTRCLATRQKKKHLFVERGGGDGIA

SEQ ID NO: 60611 - protein, 549 aa, Homo sapiens
  Payload ID: 12135
  Gene Symbol: OSGIN2
  Gene Name: oxidative stress induced growth inhibitor family member 2
  Uniprot ID: Q9Y236
  ENSP ID: ENSP00000396445
MPVWCCRCSLAGHFRNYSDTETEGEIFNSLVQYFGDNLGRKVKAMPLVEETSLLEDSSVTFPVVIIGNGPSGICLSYMLSGYRPYLSSEAIHPNTILNSKLEEARHLSIVDQDLEYLSEGLEGRSSNPVAVLFDTLLHPDADFGYDYPSVLHWKLEQHHYIPHVVLGKGPPGGAWHNMEGSMLTISFGSWMELPGLKFKDWVSSKRRSLKGDRVMPEEIARYYKHYVKVMGLQKNFRENTYITSVSRLYRDQDDDDIQDRDISTKHLQIEKSNFIKRNWEIRGYQRIADGSHVPFCLFAENVALATGTLDSPAHLEIEGEDFPFVFHSMPEFGAAINKGKLRGKVDPVLIVGSGLTAADAVLCAYNSNIPVIHVFRRRVTDPSLIFKQLPKKLYPEYHKVYHMMCTQSYSVDSNLLSDYTSFPEHRVLSFKSDMKCVLQSVSGLKKIFKLSAAVVLIGSHPNLSFLKDQGCYLGHKSSQPITCKGNPVEIDTYTYECIKEANLFALGPLVGDNFVRFLKGGALGVTRCLATRQKKKHLFVERGGGDGIA

SEQ ID NO: 60612 - protein, 207 aa, Homo sapiens
  Payload ID: 12135
  Gene Symbol: OSGIN2
  Gene Name: oxidative stress induced growth inhibitor family member 2
  ENSP ID: ENSP00000431029
MPVWCCRCSLAGHFRNYSDTETEGEIFNSLVQYFGDNLGRKVKAMPLVEETSLLEDSSVTFPVVIIGNGPSGICLSYMLSGYRPYLSSEAIHPNTILNSKLEEARHLSIVDQDLEYLSEGLEGRSSNPVAVLFDTLLHPDADFGYDYPSVLHWKLEQHHYIPHVVLGKGPPGGAWHNMEGSMLTISFGSWMELPGLKFKDWVSSKRR

SEQ ID NO: 60613 - protein, 527 aa, Homo sapiens
  Payload ID: 12136
  Gene Symbol: OXSR1
  Gene Name: oxidative stress responsive 1
  Uniprot ID: O95747
  ENSP ID: ENSP00000311713
MSEDSSALPWSINRDDYELQEVIGSGATAVVQAAYCAPKKEKVAIKRINLEKCQTSMDELLKEIQAMSQCHHPNIVSYYTSFVVKDELWLVMKLLSGGSVLDIIKHIVAKGEHKSGVLDESTIATILREVLEGLEYLHKNGQIHRDVKAGNILLGEDGSVQIADFGVSAFLATGGDITRNKVRKTFVGTPCWMAPEVMEQVRGYDFKADIWSFGITAIELATGAAPYHKYPPMKVLMLTLQNDPPSLETGVQDKEMLKKYGKSFRKMISLCLQKDPEKRPTAAELLRHKFFQKAKNKEFLQEKTLQRAPTISERAKKVRRVPGSSGRLHKTEDGGWEWSDDEFDEESEEGKAAISQLRSPRVKESISNSELFPTTDPVGTLLQVPEQISAHLPQPAGQIATQPTQVSLPPTAEPAKTAQALSSGSGSQETKIPISLVLRLRNSKKELNDIRFEFTPGRDTAEGVSQELISAGLVDGRDLVIVAANLQKIVEEPQSNRSVTFKLASGVEGSDIPDDGKLIGFAQLSIS

SEQ ID NO: 60614 - protein, 113 aa, Homo sapiens
  Payload ID: 12136
  Gene Symbol: OXSR1
  Gene Name: oxidative stress responsive 1
  ENSP ID: ENSP00000398356
MSEDSSALPWSINRDDYELQEVIGSGATAVVQAAYCAPKKEKVAIKRINLEKCQTSMDELLKEIQAMSQCHHPNIVSYYTSFVVKDELWLVMKLLSGVTHWRNWIALLKALFI

SEQ ID NO: 60615 - protein, 468 aa, Homo sapiens
  Payload ID: 12136
  Gene Symbol: OXSR1
  Gene Name: oxidative stress responsive 1
  ENSP ID: ENSP00000415851
MSEDSSALPWSINRDDYELQEVIGSGATAVVQAAYCAPKKEKVAIKRINLEKCQTSMDELLKEIQAMSQCHHPNIVSYYTSFVVKDELWLVMKLLSGGSVLDIIKHIVAKGEHKSGVLDESTIATILREVLEGLEYLHKNGQIHRDVKAGNILLGEDGSVQIADFGVSAFLATGGDITRNKVRKTFVGTPCWMAPEVMEQVRGYDFKADIWSFGITAIELATGAAPYHKYPPMKVLMLTLQNDPPSLETGVQDKEMLKKYGKSFRKMISLCLQKDPEKRPTAAELLRHKFFQKAKNKEFLQEKTLQRAPTISERAKKVRRVPGSSGRLHKTEDGGWEWSDDEFDEESEEGKAAISQLRSPRVKESISNSELFPTTDPVGTLLQVPEQISAHLPQPAGQIATQPTQVSLPPTAEPAKTAQALSSGSGSQETKIPISLVLRLRNSKKELNDIRFEFTPGRGEASNGLKTK

SEQ ID NO: 60616 - protein, 292 aa, Homo sapiens
  Payload ID: 12137
  Gene Symbol: OSER1
  Gene Name: oxidative stress responsive serine-rich 1
  Uniprot ID: Q9NX31
  ENSP ID: ENSP00000255174
MKSEAKDGEEESLQTAFKKLRVDASGSVASLSVGEGTGVRAPVRTATDDTKPKTTCASKDSWHGSTRKSSRGAVRTQRRRRSKSPVLHPPKFIHCSTIASSSSSQLKHKSQTDSPDGSSGLGISSPKEFSAGESSTSLDANHTGAVVEPLRTSVPRLPSESKKEDSSDATQVPQASLKASDLSDFQSVSKLNQGKPCTCIGKECQCKRWHDMEVYSFSGLQSVPPLAPERRSTLEDYSQSLHARTLSGSPRSCSEQARVFVDDVTIEDLSGYMEYYLYIPKKMSHMAEMMYT

SEQ ID NO: 60617 - protein, 292 aa, Homo sapiens; identical to SEQ ID NO: 60616
  Payload ID: 12137
  Gene Symbol: OSER1
  Gene Name: oxidative stress responsive serine-rich 1
  Uniprot ID: Q9NX31
  ENSP ID: ENSP00000362061

SEQ ID NO: 60618 - protein, 273 aa, Homo sapiens
  Payload ID: 12138
  Gene Symbol: OLR1
  Gene Name: oxidized low density lipoprotein (lectin-like) receptor 1
  Uniprot ID: P78380
  ENSP ID: ENSP00000309124
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDAKLLKINSTADLDFIQQAISYSSFPFWMGLSRRNPSYPWLWEDGSPLMPHLFRVRGAVSQTYPSGTCAYIQRGAVYAENCILAAFSICQKKANLRAQ

SEQ ID NO: 60619 - protein, 104 aa, Homo sapiens
  Payload ID: 12138
  Gene Symbol: OLR1
  Gene Name: oxidized low density lipoprotein (lectin-like) receptor 1
  ENSP ID: ENSP00000340572
MIETLARKLNEKSKEQMELHHQNLNLQETLKRVANCSAPCPQDWIWHGENCYLFSSGSFNWEKSQEKCLSLDAKLLKINSTADLDFIQQAISYSSFPFWMGLSR

SEQ ID NO: 60620 - protein, 181 aa, Homo sapiens
  Payload ID: 12138
  Gene Symbol: OLR1
  Gene Name: oxidized low density lipoprotein (lectin-like) receptor 1
  Uniprot ID: P78380
  ENSP ID: ENSP00000405116
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSGLHPASNFLFQFSILDGAVSEEPQLPMALGGRFSFDAPLI

SEQ ID NO: 60621 - protein, 57 aa, Homo sapiens
  Payload ID: 12138
  Gene Symbol: OLR1
  Gene Name: oxidized low density lipoprotein (lectin-like) receptor 1
  ENSP ID: ENSP00000438744
MIETLARKLNEKSKEQMELHHQNLNLQETLKRVANCSAPCPQDWIWHGENCYLFSSG

SEQ ID NO: 60622 - protein, 122 aa, Homo sapiens
  Payload ID: 12138
  Gene Symbol: OLR1
  Gene Name: oxidized low density lipoprotein (lectin-like) receptor 1
  ENSP ID: ENSP00000438925
MIETLARKLNEKSKEQMELHHQNLNLQETLKRVANCSAPCPQDWIWHGENCYLFSSGSFNWEKSQEKCLSLDAKLLKINSTADLDFIQQAISYSSFPFWMGLSRRNPSYPWLWEDGSPLMPH

SEQ ID NO: 60623 - protein, 189 aa, Homo sapiens
  Payload ID: 12138
  Gene Symbol: OLR1
  Gene Name: oxidized low density lipoprotein (lectin-like) receptor 1
  Uniprot ID: P78380
  ENSP ID: ENSP00000439251
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDAKLLKINSTADLI

SEQ ID NO: 60624 - protein, 214 aa, Homo sapiens
  Payload ID: 12138
  Gene Symbol: OLR1
  Gene Name: oxidized low density lipoprotein (lectin-like) receptor 1
  ENSP ID: ENSP00000442389
MVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDAKLLKINSTADLDFIQQAISYSSFPFWMGLSRRNPSYPWLWEDGSPLMPHLFRVRGAVSQTYPSGTCAYIQRGAVYAENCILAAFSICQKK

SEQ ID NO: 60625 - protein, 104 aa, Homo sapiens
  Payload ID: 12138
  Gene Symbol: OLR1
  Gene Name: oxidized low density lipoprotein (lectin-like) receptor 1
  ENSP ID: ENSP00000444068
MVLGMQLSQVSDLLTQEQANLTHQKKKLEGQISARQQAEEASQESENELKEMIETLARKLNEKSKEQMELHHQNLNLQETLKRVANCSAPCPQDWIWHGENCYL

SEQ ID NO: 60626 - protein, 165 aa, Homo sapiens
  Payload ID: 12138
  Gene Symbol: OLR1
  Gene Name: oxidized low density lipoprotein (lectin-like) receptor 1
  ENSP ID: ENSP00000444457
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAVYAENCILAAFSICQKKANLRAQ

SEQ ID NO: 60627 - protein, 77 aa, Homo sapiens
  Payload ID: 12138
  Gene Symbol: OLR1
  Gene Name: oxidized low density lipoprotein (lectin-like) receptor 1
  ENSP ID: ENSP00000445085
MIETLARKLNEKSKEQMELHHQNLNLQETLKRVANCSGLHPASNFLFQFSILDGAVSEEPQLPMALGGRFSFDAPLI

SEQ ID NO: 60628 - protein, 312 aa, Homo sapiens
  Payload ID: 12139
  Gene Symbol: OXNAD1
  Gene Name: oxidoreductase NAD-binding domain containing 1
  Uniprot ID: Q96HP4
  ENSP ID: ENSP00000285083
MACAAVMIPGLLRCSVGAIRIEAASLRLTLSTLRHLTLTSIMKSKRKTDHMERTASVLRREIVSAAKVCGAASESPSVKSLRLLVADQDFSFKAGQWVDFFIPGVSVVGGFSICSSPRLLEQERVIELAVKYTNHPPALWVHNTCTLDCEVAVRVGGEFFFDPQPADASRNLVLIAGGVGINPLLSILRHAADLLREQANKRNGYEIGTIKLFYSAKNTSELLFKKNILDLVNEFPEKIACSLHVTKQTTQINAELKPYITEGRITEKEIRDHISKETLFYICGPPPMTDFFSKQLENNHVPKEHICFEKWW

SEQ ID NO: 60629 - protein, 330 aa, Homo sapiens
  Payload ID: 12139
  Gene Symbol: OXNAD1
  Gene Name: oxidoreductase NAD-binding domain containing 1
  ENSP ID: ENSP00000389872
MTPKISWTSKFSVCPESAMACAAVMIPGLLRCSVGAIRIEAASLRLTLSTLRHLTLTSIMKSKRKTDHMERTASVLRREIVSAAKVCGAASESPSVKSLRLLVADQDFSFKAGQWVDFFIPGVSVVGGFSICSSPRLLEQERVIELAVKYTNHPPALWVHNTCTLDCEVAVRVGGEFFFDPQPADASRNLVLIAGGVGINPLLSILRHAADLLREQANKRNGYEIGTIKLFYSAKNTSELLFKKNILDLVNEFPEKIACSLHVTKQTTQINAELKPYITEGRITEKEIRDHISKETLFYICGPPPMTDFFSKQLENNHVPKEHICFEKWW

SEQ ID NO: 60630 - protein, 56 aa, Homo sapiens
  Payload ID: 12139
  Gene Symbol: OXNAD1
  Gene Name: oxidoreductase NAD-binding domain containing 1
  ENSP ID: ENSP00000397374
MACAAVMIPGLLRCSVGAIRIEAASLRLTLSTLRHLTLTRLCQQLRCVELPVSHRQ

SEQ ID NO: 60631 - protein, 71 aa, Homo sapiens
  Payload ID: 12139
  Gene Symbol: OXNAD1
  Gene Name: oxidoreductase NAD-binding domain containing 1
  ENSP ID: ENSP00000398867
MACAAVMIPGLLRCSVGAIRIEAASLRLTLSTLRHLTLTSIMKSKRKTDHMERTASVLRRESNLFHQGRKH

SEQ ID NO: 60632 - protein, 312 aa, Homo sapiens; identical to SEQ ID NO: 60628
  Payload ID: 12139
  Gene Symbol: OXNAD1
  Gene Name: oxidoreductase NAD-binding domain containing 1
  Uniprot ID: Q96HP4
  ENSP ID: ENSP00000475547

SEQ ID NO: 60633 - protein, 311 aa, Homo sapiens
  Payload ID: 12139
  Gene Symbol: OXNAD1
  Gene Name: oxidoreductase NAD-binding domain containing 1
  ENSP ID: ENSP00000476239
MACAAVMIPGLLRCSVGAIRIEAASLRLTLSTLRHLTLTSIMKSKRKTDHMERTASVLRREIVSAAKVCGAASESPSVKSLRLLVADQDFSFKAGQWVDFFIPGVSVVGGFSICSSPRLLEQERVIELAVKYTNHPPALWVHNTCTLDCEVAVRVGGEFFFDPQPADASRNLVLIAGGVGINPLLSILRHAADLLREQANKRNGYEIGTIKLFYSAKNTSELLFKKNILDLVNEFPEKIACSLHVTKQTTQINAELKPYITGRITEKEIRDHISKETLFYICGPPPMTDFFSKQLENNHVPKEHICFEKWW

SEQ ID NO: 60634 - protein, 330 aa, Homo sapiens; identical to SEQ ID NO: 60629
  Payload ID: 12139
  Gene Symbol: OXNAD1
  Gene Name: oxidoreductase NAD-binding domain containing 1
  ENSP ID: ENSP00000487136

SEQ ID NO: 60635 - protein, 147 aa, Homo sapiens
  Payload ID: 12140
  Gene Symbol: OXLD1
  Gene Name: oxidoreductase-like domain containing 1
  Uniprot ID: Q5BKU9
  ENSP ID: ENSP00000363873
MLLRRVVEGGRAVAAAVRGSGARRFSSPDCCQRLPGGGSFLQRHHPGAQAPDGRRKFGTDHVEVGSQAGADGTRPPKASLPPELQPPTNCCMSGCPNCVWVEYADRLLQHFQDGGERALAALEEHVADENLKAFLRMEIRLHTRCGG

SEQ ID NO: 60636 - protein, 92 aa, Homo sapiens
  Payload ID: 12140
  Gene Symbol: OXLD1
  Gene Name: oxidoreductase-like domain containing 1
  ENSP ID: ENSP00000459191
MLLRRVVEGGRAVAAAVRGSASTRTGLGSAEGHVREAAVRGPARTGRSPGPSTRMWGRSREDRALAAAEGPLAPLLHRLLPSPRPGICGGAA

SEQ ID NO: 60637 - protein, 92 aa, Homo sapiens; identical to SEQ ID NO: 60636
  Payload ID: 12140
  Gene Symbol: OXLD1
  Gene Name: oxidoreductase-like domain containing 1
  ENSP ID: ENSP00000459281

SEQ ID NO: 60638 - protein, 79 aa, Homo sapiens
  Payload ID: 12140
  Gene Symbol: OXLD1
  Gene Name: oxidoreductase-like domain containing 1
  ENSP ID: ENSP00000459374
  MOD_RES (1)..(1): Any amino acid
XAAVRGSASTRTGLGSAEGHVREAAVRGPARTGRSPGPSTRMWGRSREDRALAAAEGPLAPLLHRLLPSPRPGICGGAA

SEQ ID NO: 60639 - protein, 92 aa, Homo sapiens; identical to SEQ ID NO: 60636
  Payload ID: 12140
  Gene Symbol: OXLD1
  Gene Name: oxidoreductase-like domain containing 1
  ENSP ID: ENSP00000466256

SEQ ID NO: 60640 - protein, 423 aa, Homo sapiens
  Payload ID: 12141
  Gene Symbol: OXER1
  Gene Name: oxoeicosanoid (OXE) receptor 1
  Uniprot ID: Q8TDS5
  ENSP ID: ENSP00000367930
MLCHRGGQLIVPIIPLCPEHSCRGRRLQNLLSGPWPKQPMELHNLSSPSPSLSSSVLPPSFSPSPSSAPSAFTTVGGSSGGPCHPTSSSLVSAFLAPILALEFVLGLVGNSLALFIFCIHTRPWTSNTVFLVSLVAADFLLISNLPLRVDYYLLHETWRFGAAACKVNLFMLSTNRTASVVFLTAIALNRYLKVVQPHHVLSRASVGAAARVAGGLWVGILLLNGHLLLSTFSGPSCLSYRVGTKPSASLRWHQALYLLEFFLPLALILFAIVSIGLTIRNRGLGGQAGPQRAMRVLAMVVAVYTICFLPSIIFGMASMVAFWLSACRSLDLCTQLFHGSLAFTYLNSVLDPVLYCFSSPNFLHQSRALLGLTRGRQGPVSDESSYQPSRQWRYREASRKAEAIGKLKVQGEVSLEKEGSSQG

SEQ ID NO: 60641 - protein, 1023 aa, Homo sapiens
  Payload ID: 12142
  Gene Symbol: OGDH
  Gene Name: oxoglutarate (alpha-ketoglutarate) dehydrogenase (lipoamide)
  Uniprot ID: Q02218
  ENSP ID: ENSP00000222673
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 60642 - protein, 427 aa, Homo sapiens
  Payload ID: 12142
  Gene Symbol: OGDH
  Gene Name: oxoglutarate (alpha-ketoglutarate) dehydrogenase (lipoamide)
  Uniprot ID: Q02218
  ENSP ID: ENSP00000388084
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVRPRERRARQIVKAPCSSMEFRSPT

SEQ ID NO: 60643 - protein, 1034 aa, Homo sapiens
  Payload ID: 12142
  Gene Symbol: OGDH
  Gene Name: oxoglutarate (alpha-ketoglutarate) dehydrogenase (lipoamide)
  ENSP ID: ENSP00000388183
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQVRGHHIAKLDPLGISCVNFDDAPVTVSSNVDLAVFKERLRMLTVGGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 60644 - protein, 1019 aa, Homo sapiens
  Payload ID: 12142
  Gene Symbol: OGDH
  Gene Name: oxoglutarate (alpha-ketoglutarate) dehydrogenase (lipoamide)
  Uniprot ID: Q02218
  ENSP ID: ENSP00000392878
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQVRGHHIAKLDPLGISCVNFDDAPVTVSSNVGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 60645 - protein, 873 aa, Homo sapiens
  Payload ID: 12142
  Gene Symbol: OGDH
  Gene Name: oxoglutarate (alpha-ketoglutarate) dehydrogenase (lipoamide)
  ENSP ID: ENSP00000398576
MFHLRTCAAKLRPLTASQTVKTFSQNRPAAARTFQQIRCYSAPVAAEPFLSGTSSNYVEEMYCAWLENPKSVHKGSMAWMSLTSTRSSTCPPPLSSGDRNQHFLCGRSSVGWRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 60646 - protein, 211 aa, Homo sapiens
  Payload ID: 12142
  Gene Symbol: OGDH
  Gene Name: oxoglutarate (alpha-ketoglutarate) dehydrogenase (lipoamide)
  ENSP ID: ENSP00000411830
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLE

SEQ ID NO: 60647 - protein, 1038 aa, Homo sapiens
  Payload ID: 12142
  Gene Symbol: OGDH
  Gene Name: oxoglutarate (alpha-ketoglutarate) dehydrogenase (lipoamide)
  ENSP ID: ENSP00000414662
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLDLAVFKERLRMLTVGGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 60648 - protein, 1001 aa, Homo sapiens
  Payload ID: 12142
  Gene Symbol: OGDH
  Gene Name: oxoglutarate (alpha-ketoglutarate) dehydrogenase (lipoamide)
  ENSP ID: ENSP00000486854
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGLAGLRMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTH

SEQ ID NO: 60649 - protein, 337 aa, Homo sapiens
  Payload ID: 12143
  Gene Symbol: OXGR1
  Gene Name: oxoglutarate (alpha-ketoglutarate) receptor 1
  Uniprot ID: Q96P68
  ENSP ID: ENSP00000298440
MNEPLDYLANASDFPDYAAAFGNCTDENIPLKMHYLPVIYGIIFLVGFPGNAVVISTYIFKMRPWKSSTIIMLNLACTDLLYLTSLPFLIHYYASGENWIFGDFMCKFIRFSFHFNLYSSILFLTCFSIFRYCVIIHPMSCFSIHKTRCAVVACAVVWIISLVAVIPMTFLITSTNRTNRSACLDLTSSDELNTIKWYNLILTATTFCLPLVIVTLCYTTIIHTLTHGLQTDSCLKQKARRLTILLLLAFYVCFLPFHILRVIRIESRLLSISCSIENQIHEAYIVSRPLAALNTFGNLLLYVVVSDNFQQAVCSTVRCKVSGNLEQAKKISYSNNP

SEQ ID NO: 60650 - protein, 62 aa, Homo sapiens
  Payload ID: 12143
  Gene Symbol: OXGR1
  Gene Name: oxoglutarate (alpha-ketoglutarate) receptor 1
  ENSP ID: ENSP00000437356
MNEPLDYLANASDFPDYAAAFGNCTDENIPLKMHYLPVIYGIIFLVGFPGNAVVISTYIFKM

SEQ ID NO: 60651 - protein, 337 aa, Homo sapiens; identical to SEQ ID NO: 60649
  Payload ID: 12143
  Gene Symbol: OXGR1
  Gene Name: oxoglutarate (alpha-ketoglutarate) receptor 1
  Uniprot ID: Q96P68
  ENSP ID: ENSP00000438800

SEQ ID NO: 60652 - protein, 69 aa, Homo sapiens
  Payload ID: 12143
  Gene Symbol: OXGR1
  Gene Name: oxoglutarate (alpha-ketoglutarate) receptor 1
  ENSP ID: ENSP00000445269
MNEPLDYLANASDFPDYAAAFGNCTDENIPLKMHYLPVIYGIIFLVGFPGNAVVISTYIFKMRPWKSST

SEQ ID NO: 60653 - protein, 1010 aa, Homo sapiens
  Payload ID: 12144
  Gene Symbol: OGDHL
  Gene Name: oxoglutarate dehydrogenase-like
  Uniprot ID: Q9ULD0
  ENSP ID: ENSP00000363216
MSQLRLLPSRLGVQAARLLAAHDVPVFGWRSRSSGPPATFPSSKGGGGSSYMEEMYFAWLENPQSVHKSWDSFFREASEEAFSGSAQPRPPSVVHESRSAVSSRTKTSKLVEDHLAVQSLIRAYQIRGHHVAQLDPLGILDADLDSFVPSDLITTIDKLAFYDLQEADLDKEFQLPTTTFIGGSENTLSLREIIRRLENTYCQHIGLEFMFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFSHRHHVLHDQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 60654 - protein, 801 aa, Homo sapiens
  Payload ID: 12144
  Gene Symbol: OGDHL
  Gene Name: oxoglutarate dehydrogenase-like
  Uniprot ID: Q9ULD0
  ENSP ID: ENSP00000390240
MFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFSHRHHVLHDQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 60655 - protein, 953 aa, Homo sapiens
  Payload ID: 12144
  Gene Symbol: OGDHL
  Gene Name: oxoglutarate dehydrogenase-like
  Uniprot ID: Q9ULD0
  ENSP ID: ENSP00000401356
MSQLRLLPSRLGVQAARLLAAHDVPVFGWRSRSSGPPATFPSSKGGGGSSYMEEMYFAWLENPQSVHKIRGHHVAQLDPLGILDADLDSFVPSDLITTIDKLAFYDLQEADLDKEFQLPTTTFIGGSENTLSLREIIRRLENTYCQHIGLEFMFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFSHRHHVLHDQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 60656 - protein, 807 aa, Homo sapiens
  Payload ID: 12145
  Gene Symbol: OSBP
  Gene Name: oxysterol binding protein
  Uniprot ID: P22059
  ENSP ID: ENSP00000263847
MAATELRGVVGPGPAAIAALGGGGAGPPVVGGGGGRGDAGPGSGAASGTVVAAAAGGPGPGAGGVAAAGPAPAPPTGGSGGSGAGGSGSAREGWLFKWTNYIKGYQRRWFVLSNGLLSYYRSKAEMRHTCRGTINLATANITVEDSCNFIISNGGAQTYHLKASSEVERQRWVTALELAKAKAVKMLAESDESGDEESVSQTDKTELQNTLRTLSSKVEDLSTCNDLIAKHGTALQRSLSELESLKLPAESNEKIKQVNERATLFRITSNAMINACRDFLMLAQTHSKKWQKSLQYERDQRIRLEETLEQLAKQHNHLERAFRGATVLPANTPGNVGSGKDQCCSGKGDMSDEDDENEFFDAPEIITMPENLGHKRTGSNISGASSDISLDEQYKHQLEETKKEKRTRIPYKPNYSLNLWSIMKNCIGKELSKIPMPVNFNEPLSMLQRLTEDLEYHELLDRAAKCENSLEQLCYVAAFTVSSYSTTVFRTSKPFNPLLGETFELDRLEENGYRSLCEQVSHHPPAAAHHAESKNGWTLRQEIKITSKFRGKYLSIMPLGTIHCIFHATGHHYTWKKVTTTVHNIIVGKLWIDQSGEIDIVNHKTGDKCNLKFVPYSYFSRDVARKVTGEVTDPSGKVHFALLGTWDEKMECFKVQPVIGENGGDARQRGHEAEESRVMLWKRNPLPKNAENMYYFSELALTLNAWESGTAPTDSRLRPDQRLMENGRWDEANAEKQRLEEKQRLSRKKREAEAMKATEDGTPYDPYKALWFERKKDPVTKELTHIYRGEYWECKEKQDWSSCPDIF

SEQ ID NO: 60657 - protein, 171 aa, Homo sapiens
  Payload ID: 12145
  Gene Symbol: OSBP
  Gene Name: oxysterol binding protein
  ENSP ID: ENSP00000432399
  MOD_RES (1)..(1): Any amino acid
XSGASSDISLDEQYKHQLEETKKEKRTRIPYKPNYSLNLWSIMKNCIGKELSKIPMPVNFNEPLSMLQRLTEDLEYHELLDRAAKCENSLEQLCYVAAFTVSSYSTTVFRTSKPFNPLLGETFELDRLEENGYRSLCEQVPFIVFSMQLGTTTLGRKLPQLYTTLLWASCG

SEQ ID NO: 60658 - protein, 916 aa, Homo sapiens
  Payload ID: 12146
  Gene Symbol: OSBP2
  Gene Name: oxysterol binding protein 2
  Uniprot ID: Q969R2
  ENSP ID: ENSP00000332576
MGKAAAPSRGGGCGGRSRGLSSLFTVVPCLSCHTAAPGMSASTSGSGPEPKPQPQPVPEPERGPLSEQVSEAVSEAVPRSEPVSETTSEPEPGAGQPSELLQGSRPGSESSSGVGAGPFTKAASEPLSRAVGSATFLRPESGSLPALKPLPLLRPGQAKTPLGVPMSGTGTTSSAPLALLPLDSFEGWLLKWTNYLKGYQRRWFVLGNGLLSYYRNQGEMAHTCRGTINLSTAHIDTEDSCGILLTSGARSYHLKASSEVDRQQWITALELAKAKAVRVMNTHSDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 60659 - protein, 636 aa, Homo sapiens
  Payload ID: 12146
  Gene Symbol: OSBP2
  Gene Name: oxysterol binding protein 2
  ENSP ID: ENSP00000384213
MNTHSDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGDLLTPKGEDSEEDEDTEYFDAMEDSTSFITVITEAKEDRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 60660 - protein, 743 aa, Homo sapiens
  Payload ID: 12146
  Gene Symbol: OSBP2
  Gene Name: oxysterol binding protein 2
  ENSP ID: ENSP00000385237
MSSLAAKRLGMNRRPAGSGGGGGEAATWGHRFWRPQERPTDRNQGEMAHTCRGTINLSTAHIDTEDSCGILLTSGARSYHLKASSEVDRQQWITALELAKAKAVRVMNTHSDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 60661 - protein, 549 aa, Homo sapiens
  Payload ID: 12146
  Gene Symbol: OSBP2
  Gene Name: oxysterol binding protein 2
  Uniprot ID: Q969R2
  ENSP ID: ENSP00000385254
MINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 60662 - protein, 174 aa, Homo sapiens
  Payload ID: 12146
  Gene Symbol: OSBP2
  Gene Name: oxysterol binding protein 2
  ENSP ID: ENSP00000388575
MINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPM

SEQ ID NO: 60663 - protein, 659 aa, Homo sapiens
  Payload ID: 12146
  Gene Symbol: OSBP2
  Gene Name: oxysterol binding protein 2
  Uniprot ID: Q969R2
  ENSP ID: ENSP00000389200
MKGRGCWDTASVRSFCSSGCLNKFKKDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEAEKEADAYTPLWFEKRLDPLTGEMACVYKGGYWEAKEKQDWHMCPNIF

SEQ ID NO: 60664 - protein, 915 aa, Homo sapiens
  Payload ID: 12146
  Gene Symbol: OSBP2
  Gene Name: oxysterol binding protein 2
  Uniprot ID: Q969R2
  ENSP ID: ENSP00000392080
MGKAAAPSRGGGCGGRSRGLSSLFTVVPCLSCHTAAPGMSASTSGSGPEPKPQPQPVPEPERGPLSEQVSEAVSEAVPRSEPVSETTSEPEPGAGQPSELLQGSRPGSESSSGVGAGPFTKAASEPLSRAVGSATFLRPESGSLPALKPLPLLRPGQAKTPLGVPMSGTGTTSSAPLALLPLDSFEGWLLKWTNYLKGYQRRWFVLGNGLLSYYRNQGEMAHTCRGTINLSTAHIDTEDSCGILLTSGARSYHLKASSEVDRQQWITALELAKAKAVRVMNTHSDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 60665 - protein, 74 aa, Homo sapiens
  Payload ID: 12146
  Gene Symbol: OSBP2
  Gene Name: oxysterol binding protein 2
  ENSP ID: ENSP00000392362
  MOD_RES (1)..(1): Any amino acid
XAIHLEFQASGNHYVWRKSTSTVHNIIVGKLWIDQSGDIEIVNHKTNDRCQLKFLPYSYFSKEAARKVSRTSHL

SEQ ID NO: 60666 - protein, 298 aa, Homo sapiens
  Payload ID: 12146
  Gene Symbol: OSBP2
  Gene Name: oxysterol binding protein 2
  ENSP ID: ENSP00000401776
  MOD_RES (1)..(1): Any amino acid
XHSENSRATPGACLSPQHSQDGAWRRPAAAEETLGVRDGHQACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHH

SEQ ID NO: 60667 - protein, 196 aa, Homo sapiens
  Payload ID: 12146
  Gene Symbol: OSBP2
  Gene Name: oxysterol binding protein 2
  ENSP ID: ENSP00000409011
  MOD_RES (1)..(1): Any amino acid
XHSENSRATPGACLSPQHSQDGAWRRPAAAEETLGVRDGHQACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNGSSKVKRRVRIPNKPNYSLNLWSIMKNCIGRE

SEQ ID NO: 60668 - protein, 450 aa, Homo sapiens
  Payload ID: 12146
  Gene Symbol: OSBP2
  Gene Name: oxysterol binding protein 2
  ENSP ID: ENSP00000409838
ACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKGERGEHVLLLRAGPDPQRARGGRSANRQPPAARPAADGEGPLGRGQYREAAAGGEAAPVAAPAAGGLRAGQQLQLGGREGGGCLHATVV

SEQ ID NO: 60669 - protein, 750 aa, Homo sapiens
  Payload ID: 12146
  Gene Symbol: OSBP2
  Gene Name: oxysterol binding protein 2
  Uniprot ID: Q969R2
  ENSP ID: ENSP00000411052
MHRQRTRTMSSLAAKRLGMNRRPAGSGGGGGEAATWGHRFWRPQERPTDRNQGEMAHTCRGTINLSTAHIDTEDSCGILLTSGARSYHLKASSEVDRQQWITALELAKAKAVRVMNTHSDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 60670 - protein, 25 aa, Homo sapiens
  Payload ID: 12146
  Gene Symbol: OSBP2
  Gene Name: oxysterol binding protein 2
  ENSP ID: ENSP00000411497
MINACRDFLELAEIHSRKWQRALQY

SEQ ID NO: 60671 - protein, 588 aa, Homo sapiens
  Payload ID: 12146
  Gene Symbol: OSBP2
  Gene Name: oxysterol binding protein 2
  ENSP ID: ENSP00000415274
  MOD_RES (1)..(1): Any amino acid
XHSENSRATPGACLSPQHSQDGAWRRPAAAEETLGVRDGHQACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 60672 - protein, 460 aa, Homo sapiens
  Payload ID: 12146
  Gene Symbol: OSBP2
  Gene Name: oxysterol binding protein 2
  Uniprot ID: Q969R2
  ENSP ID: ENSP00000438713
MEDSTSFITVITEAKEDRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 60673 - protein, 764 aa, Homo sapiens
  Payload ID: 12147
  Gene Symbol: OSBPL10
  Gene Name: oxysterol binding protein-like 10
  Uniprot ID: Q9BXB5
  ENSP ID: ENSP00000379804
MERAVQGTDGGGGSNSSSRSSSRATSAGSSPSCSLAGRGVSSRSAAAGLGGGGSRSSPGSVAASPSGGGGRRREPALEGVLSKYTNLLQGWQNRYFVLDFEAGILQYFVNEQSKHQKPRGVLSLSGAIVSLSDEAPHMLVVYSANGEMFKLRAADAKEKQFWVTQLRACAKYHMEMNSKSAPSSRSRSLTLLPHGTPNSASPCSQRHLSVGAPGVVTITHHKSPAAARRAKSQYSGQLHEVREMMNQVEGQQKNLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPEPNSGSELVLSEDEKSDNEDKEETELGVMEDQRSIILHLISQLKLGMDLTKVVLPTFILEKRSLLEMYADFMAHPDLLLAITAGATPEERVICFVEYYLTAFHEGRKGALAKKPYNPIIGETFHCSWEVPKDRVKPKRTASRSPASCHEHPMADDPSKSYKLRFVAEQVSHHPPISCFYCECEEKRLCVNTHVWTKSKFMGMSVGVSMIGEGVLRLLEHGEEYVFTLPSAYARSILTIPWVELGGKVSINCAKTGYSATVIFHTKPFYGGKVHRVTAEVKHNPTNTIVCKAHGEWNGTLEFTYNNGETKVIDTTTLPVYPKKIRPLEKQGPMESRNLWREVTRYLRLGDIDAATEQKRHLEEKQRVEERKRENLRTPWKPKYFIQEGDGWVYFNPLWKAH

SEQ ID NO: 60674 - protein, 173 aa, Homo sapiens
  Payload ID: 12147
  Gene Symbol: OSBPL10
  Gene Name: oxysterol binding protein-like 10
  ENSP ID: ENSP00000399200
KSPAAARRAKSQYSGQLHEVREVKACMLNNMCEVTQRVIGIVKTQTQLIFLMMNQVEGQQKNLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPE

SEQ ID NO: 60675 - protein, 700 aa, Homo sapiens
  Payload ID: 12147
  Gene Symbol: OSBPL10
  Gene Name: oxysterol binding protein-like 10
  Uniprot ID: Q9BXB5
  ENSP ID: ENSP00000406124
MERAVQGTDGGGGSNSSSRSSSRATSAGSSPSCSLAGRGVSSRSAAAGLGGGGSRSSPGSVAASPSGGGGRRREPALEGVLSKYTNLLQGWQNRYFVLDFEAGILQYFVNEQSKHQKPRGVLSLSGAIVSLSDEAPHMLVVYSANGEMFKLRAADAKEKQFWVTQLRACAKYHMEMNSKMMNQVEGQQKNLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPEPNSGSELVLSEDEKSDNEDKEETELGVMEDQRSIILHLISQLKLGMDLTKVVLPTFILEKRSLLEMYADFMAHPDLLLAITAGATPEERVICFVEYYLTAFHEGRKGALAKKPYNPIIGETFHCSWEVPKDRVKPKRTASRSPASCHEHPMADDPSKSYKLRFVAEQVSHHPPISCFYCECEEKRLCVNTHVWTKSKFMGMSVGVSMIGEGVLRLLEHGEEYVFTLPSAYARSILTIPWVELGGKVSINCAKTGYSATVIFHTKPFYGGKVHRVTAEVKHNPTNTIVCKAHGEWNGTLEFTYNNGETKVIDTTTLPVYPKKIRPLEKQGPMESRNLWREVTRYLRLGDIDAATEQKRHLEEKQRVEERKRENLRTPWKPKYFIQEGDGWVYFNPLWKAH

SEQ ID NO: 60676 - protein, 538 aa, Homo sapiens
  Payload ID: 12147
  Gene Symbol: OSBPL10
  Gene Name: oxysterol binding protein-like 10
  ENSP ID: ENSP00000416078
  MOD_RES (1)..(1): Any amino acid
XQYSGQLHEVREMMNQVEGQQKNLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPEPNSGSELVLSEDEKSDNEDKEETELGVMEDQRSIILHLISQLKLGMDLTKVVLPTFILEKRSLLEMYADFMAHPDLLLAITAGATPEERVICFVEYYLTAFHEGRKGALAKKPYNPIIGETFHCSWEVPKDRVKPKRTASRSPASCHEHPMADDPSKSYKLRFVAEQVSHHPPISCFYCECEEKRLCVNTHVWTKSKFMGMSVGVSMIGEGVLRLLEHGEEYVFTLPSAYARSILTIPWVELGGKVSINCAKTGYSATVIFHTKPFYGGKVHRVTAEVKHNPTNTIVCKAHGEWNGTLEFTYNNGETKVIDTTTLPVYPKKIRPLEKQGPMESRNLWREVTRYLRLGDIDAATEQKRHLEEKQRVEERKRENLRTPWKPKYFIQEVTLPPVIGPLPRRELVLRG

SEQ ID NO: 60677 - protein, 747 aa, Homo sapiens
  Payload ID: 12148
  Gene Symbol: OSBPL11
  Gene Name: oxysterol binding protein-like 11
  Uniprot ID: Q9BXB4
  ENSP ID: ENSP00000296220
MQGGEPVSTMKVSESEGKLEGQATAVTPNKNSSCGGGISSSSSSRGGSAKGWQYSDHMENVYGYLMKYTNLVTGWQYRFFVLNNEAGLLEYFVNEQSRNQKPRGTLQLAGAVISPSDEDSHTFTVNAASGEQYKLRATDAKERQHWVSRLQICTQHHTEAIGKNNPPLKSRSFSLASSSNSPISQRRPSQNAISFFNVGHSKLQSLSKRTNLPPDHLVEVREMMSHAEGQQRDLIRRIECLPTSGHLSSLDQDLLMLKATSMATMNCLNDCFHILQLQHASHQKGSLPSGTTIEWLEPKISLSNHYKNGADQPFATDQSKPVAVPEEQPVAESGLLAREPEEINADDEIEDTCDHKEDDLGAVEEQRSVILHLLSQLKLGMDLTRVVLPTFILEKRSLLEMYADFMSHPDLFIAITNGATAEDRMIRFVEYYLTSFHEGRKGAIAKKPYNPIIGETFHCSWKMPKSEVASSVFSSSSTQGVTNHAPLSGESLTQVGSDCYTVRFVAEQVSHHPPVSGFYAECTERKMCVNAHVWTKSKFLGMSIGVTMVGEGILSLLEHGEEYTFSLPCAYARSILTVPWVELGGKVSVNCAKTGYSASITFHTKPFYGGKLHRVTAEVKHNITNTVVCRVQGEWNSVLEFTYSNGETKYVDLTKLAVTKKRVRPLEKQDPFESRRLWKNVTDSLRESEIDKATEHKHTLEERQRTEERHRTETGTPWKTKYFIKEGDGWVYHKPLWKIIPTTQPAE

SEQ ID NO: 60678 - protein, 950 aa, Homo sapiens
  Payload ID: 12149
  Gene Symbol: OSBPL1A
  Gene Name: oxysterol binding protein-like 1A
  Uniprot ID: Q9BXW6
  ENSP ID: ENSP00000320291
MNTEAEQQLLHHARNGNAEEVRQLLETMARNEVIADINCKGRSKSNLGWTPLHLACYFGHRQVVQDLLKAGAEVNVLNDMGDTPLHRAAFTGRKELVMLLLEYNADTTIVNGSGQTAKEVTHAEEIRSMLEAVERTQQRKLEELLLAAAREGKTTELTALLNRPNPPDVNCSDQLGNTPLHCAAYRAHKQCALKLLRSGADPNLKNKNDQKPLDLAQGAEMKHILVGNKVIYKALKRYEGPLWKSSRFFGWRLFWVVLEHGVLSWYRKQPDAVHNIYRQGCKHLTQAVCTVKSTDSCLFFIKCFDDTIHGFRVPKNSLQQSREDWLEAIEEHSAYSTHYCSQDQLTDEEEEDTVSAADLKKSLEKAQSCQQRLDREISNFLKMIKECDMAKEMLPSFLQKVEVVSEASRETCVALTDCLNLFTKQEGVRNFKLEQEQEKNKILSEALETLATEHHELEQSLVKGSPPASILSEDEFYDALSDSESERSLSRLEAVTARSFEEEGEHLGSRKHRMSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVRDDLGFRLISEQVSHHPPISAFHAEGLNNDFIFHGSIYPKLKFWGKSVEAEPKGTITLELLEHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 60679 - protein, 568 aa, Homo sapiens
  Payload ID: 12149
  Gene Symbol: OSBPL1A
  Gene Name: oxysterol binding protein-like 1A
  Uniprot ID: Q9BXW6
  ENSP ID: ENSP00000349545
MIKECDMAKEMLPSFLQKVEVVSEASRETCVALTDCLNLFTKQEGVRNFKLEQEQEKNKILSEALETLATEHHELEQSLVKGSPPASILSEDEFYDALSDSESERSLSRLEAVTARSFEEEGEHLGSRKHRMSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVRDDLGFRLISEQVSHHPPISAFHAEGLNNDFIFHGSIYPKLKFWGKSVEAEPKGTITLELLEHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 60680 - protein, 100 aa, Homo sapiens
  Payload ID: 12149
  Gene Symbol: OSBPL1A
  Gene Name: oxysterol binding protein-like 1A
  ENSP ID: ENSP00000382370
MNTEAEQQLLHHARNGNAEEVRQLLETMARNEVIADINCKGRSKSNLGWTPLHLACYFGHRQVVQDLLKAGAEVNVLNDMGDTPLHRAAFTGRKICSQGS

SEQ ID NO: 60681 - protein, 437 aa, Homo sapiens
  Payload ID: 12149
  Gene Symbol: OSBPL1A
  Gene Name: oxysterol binding protein-like 1A
  Uniprot ID: Q9BXW6
  ENSP ID: ENSP00000382372
MSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVRDDLGFRLISEQVSHHPPISAFHAEGLNNDFIFHGSIYPKLKFWGKSVEAEPKGTITLELLEHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 60682 - protein, 48 aa, Homo sapiens
  Payload ID: 12149
  Gene Symbol: OSBPL1A
  Gene Name: oxysterol binding protein-like 1A
  ENSP ID: ENSP00000462155
MSEEKDCGGGDALSNGIKKHRTSLPSPMFSRNDFSIWSILRKCIGMTQ

SEQ ID NO: 60683 - protein, 51 aa, Homo sapiens
  Payload ID: 12149
  Gene Symbol: OSBPL1A
  Gene Name: oxysterol binding protein-like 1A
  ENSP ID: ENSP00000462477
MNTEAEQQLLHHARNGNAEEVRQLLETMARNEVIADINCKGRSWCRSECVE

SEQ ID NO: 60684 - protein, 51 aa, Homo sapiens
  Payload ID: 12149
  Gene Symbol: OSBPL1A
  Gene Name: oxysterol binding protein-like 1A
  ENSP ID: ENSP00000462887
MNTEAEQQLLHHARNGNAEEVRQLLETMARNEVIADINCKGRRVGNASLRI

SEQ ID NO: 60685 - protein, 49 aa, Homo sapiens
  Payload ID: 12149
  Gene Symbol: OSBPL1A
  Gene Name: oxysterol binding protein-like 1A
  ENSP ID: ENSP00000463452
MNTEAEQQLLHHARNGNAEEVRQLLETMARNEVIADINCKGVGNASLRI

SEQ ID NO: 60686 - protein, 41 aa, Homo sapiens
  Payload ID: 12149
  Gene Symbol: OSBPL1A
  Gene Name: oxysterol binding protein-like 1A
  ENSP ID: ENSP00000464541
MIKECDMAKDCLYDMSFVMMKCFHHFFRKLKLSQKLLEKLV

SEQ ID NO: 60687 - protein, 285 aa, Homo sapiens
  Payload ID: 12149
  Gene Symbol: OSBPL1A
  Gene Name: oxysterol binding protein-like 1A
  ENSP ID: ENSP00000464617
CVAAFAVSAVASQWERTGKPFNPLLGETYELVRHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 60688 - protein, 480 aa, Homo sapiens
  Payload ID: 12150
  Gene Symbol: OSBPL2
  Gene Name: oxysterol binding protein-like 2
  Uniprot ID: Q9H1P3
  ENSP ID: ENSP00000316649
MNGEEEFFDAVTGFDSDNSSGEFSEANQKVTGMIDLDTSKNNRIGKTGERPSQENGIQKHRTSLPAPMFSRSDFSVWTILKKCVGLELSKITMPIAFNEPLSFLQRITEYMEHVYLIHRASCQPQPLERMQSVAAFAVSAVASQWERTGKPFNPLLGETYELIREDLGFRFISEQVSHHPPISAFHSEGLNHDFLFHGSIYPKLKFWGKSVEAEPRGTITLELLKHNEAYTWTNPTCCVHNVIIGKLWIEQYGTVEILNHRTGHKCVLHFKPCGLFGKELHKVEGHIQDKNKKKLFMIYGKWTECLWGIDPVSYESFKKQERRGDHLRKAKLDEDSGKADSDVADDVPVAQETVQVIPGSKLLWRINTRPPNSAQMYNFTSFTVSLNELETGMEKTLPPTDCRLRPDIRGMENGNMDLASQEKERLEEKQREARRERAKEEAEWQTRWFYPGNNPYTGTPDWLYAGDYFERNFSDCPDIY

SEQ ID NO: 60689 - protein, 468 aa, Homo sapiens
  Payload ID: 12150
  Gene Symbol: OSBPL2
  Gene Name: oxysterol binding protein-like 2
  Uniprot ID: Q9H1P3
  ENSP ID: ENSP00000350755
MNGEEEFFDAVTEANQKVTGMIDLDTSKNNRIGKTGERPSQENGIQKHRTSLPAPMFSRSDFSVWTILKKCVGLELSKITMPIAFNEPLSFLQRITEYMEHVYLIHRASCQPQPLERMQSVAAFAVSAVASQWERTGKPFNPLLGETYELIREDLGFRFISEQVSHHPPISAFHSEGLNHDFLFHGSIYPKLKFWGKSVEAEPRGTITLELLKHNEAYTWTNPTCCVHNVIIGKLWIEQYGTVEILNHRTGHKCVLHFKPCGLFGKELHKVEGHIQDKNKKKLFMIYGKWTECLWGIDPVSYESFKKQERRGDHLRKAKLDEDSGKADSDVADDVPVAQETVQVIPGSKLLWRINTRPPNSAQMYNFTSFTVSLNELETGMEKTLPPTDCRLRPDIRGMENGNMDLASQEKERLEEKQREARRERAKEEAEWQTRWFYPGNNPYTGTPDWLYAGDYFERNFSDCPDIY

SEQ ID NO: 60690 - protein, 370 aa, Homo sapiens
  Payload ID: 12150
  Gene Symbol: OSBPL2
  Gene Name: oxysterol binding protein-like 2
  ENSP ID: ENSP00000397602
MPIAFNEPLSFLQRITEYMEHVYLIHRASCQPQPLERMQSVAAFAVSAVASQWERTGKPFNPLLGETYELIREDLGFRFISEQVSHHPPISAFHSEGLNHDFLFHGSIYPKLKFWGKSVEAEPRGTITLELLKHNEAYTWTNPTCCVHNVIIGKLWIEQYGTVEILNHRTGHKCVLHFKPCGLFGKELHKVEGHIQDKNKKKLFMIYGKWTECLWGIDPVSYESFKKQERRGDHLRKAKLDEDSGKADSDVADDVPVAQETVQVIPGSKLLWRINTRPPNSAQIWPARRRSGWRRSREKHGGSGPRRRQSGRRGGSTQAITPTLGPPTGCMQGITLSGISPTAQISTEGLEGPGARDRRLTRLDFLEWPL

SEQ ID NO: 60691 - protein, 76 aa, Homo sapiens
  Payload ID: 12150
  Gene Symbol: OSBPL2
  Gene Name: oxysterol binding protein-like 2
  ENSP ID: ENSP00000415751
KPFNPLLGETYELIREDLGFRFISEQVSHHPPISAFHSEGLNHDFLFHGSIYPKLKFWGKSVEAEPRGTITLELLK

SEQ ID NO: 60692 - protein, 180 aa, Homo sapiens
  Payload ID: 12150
  Gene Symbol: OSBPL2
  Gene Name: oxysterol binding protein-like 2
  ENSP ID: ENSP00000478158
MNGEEEFFDAVTGFDSDNSSGEFSEANQKVTGMIDLDTSKNNRIGKTGERPSQENGIQKHRTSLPAPMFSRSDFSVWTILKKCVGLELSKITMPIAFNEPLSFLQRITEYMEHVYLIHRASCQPQPLERMQSVAAFAVSAVASQWERTGKPFNPLLGETYELIREDLGFRFISEQVSHHP

SEQ ID NO: 60693 - protein, 22 aa, Homo sapiens
  Payload ID: 12150
  Gene Symbol: OSBPL2
  Gene Name: oxysterol binding protein-like 2
  ENSP ID: ENSP00000479702
MNGEEEFFDAVTGFDSDNSSGE

SEQ ID NO: 60694 - protein, 887 aa, Homo sapiens
  Payload ID: 12151
  Gene Symbol: OSBPL3
  Gene Name: oxysterol binding protein-like 3
  Uniprot ID: Q9H4L5
  ENSP ID: ENSP00000315410
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 60695 - protein, 851 aa, Homo sapiens
  Payload ID: 12151
  Gene Symbol: OSBPL3
  Gene Name: oxysterol binding protein-like 3
  Uniprot ID: Q9H4L5
  ENSP ID: ENSP00000379706
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 60696 - protein, 856 aa, Homo sapiens
  Payload ID: 12151
  Gene Symbol: OSBPL3
  Gene Name: oxysterol binding protein-like 3
  Uniprot ID: Q9H4L5
  ENSP ID: ENSP00000379708
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 60697 - protein, 606 aa, Homo sapiens
  Payload ID: 12151
  Gene Symbol: OSBPL3
  Gene Name: oxysterol binding protein-like 3
  Uniprot ID: Q9H4L5
  ENSP ID: ENSP00000386325
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVRSQPSLATVQPRSPSHEAIHGAHQRDSPCSLRFHFDCSVNRFITQSCLASSAWLFPVTL

SEQ ID NO: 60698 - protein, 611 aa, Homo sapiens
  Payload ID: 12151
  Gene Symbol: OSBPL3
  Gene Name: oxysterol binding protein-like 3
  Uniprot ID: Q9H4L5
  ENSP ID: ENSP00000386429
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVRSQPSLATVQPRSPSHEAIHGAHQRDSPCSLRFHFDCSVNRFITQSCLASSAWLFPVTL

SEQ ID NO: 60699 - protein, 642 aa, Homo sapiens
  Payload ID: 12151
  Gene Symbol: OSBPL3
  Gene Name: oxysterol binding protein-like 3
  Uniprot ID: Q9H4L5
  ENSP ID: ENSP00000386801
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVRSQPSLATVQPRSPSHEAIHGAHQRDSPCSLRFHFDCSVNRFITQSCLASSAWLFPVTL

SEQ ID NO: 60700 - protein, 820 aa, Homo sapiens
  Payload ID: 12151
  Gene Symbol: OSBPL3
  Gene Name: oxysterol binding protein-like 3
  Uniprot ID: Q9H4L5
  ENSP ID: ENSP00000386953
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 60701 - protein, 575 aa, Homo sapiens
  Payload ID: 12151
  Gene Symbol: OSBPL3
  Gene Name: oxysterol binding protein-like 3
  Uniprot ID: Q9H4L5
  ENSP ID: ENSP00000386990
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVRSQPSLATVQPRSPSHEAIHGAHQRDSPCSLRFHFDCSVNRFITQSCLASSAWLFPVTL

SEQ ID NO: 60702 - protein, 89 aa, Homo sapiens
  Payload ID: 12151
  Gene Symbol: OSBPL3
  Gene Name: oxysterol binding protein-like 3
  ENSP ID: ENSP00000403374
MMSDEKNLGVSQKLVSPSRSTSSCSSKQGSRQDSWEVVEGLRGEMNYTQEPPVQKGFLLKKRKWPLKGWHKRFFYLDKGILKYAKSQTD

SEQ ID NO: 60703 - protein, 112 aa, Homo sapiens
  Payload ID: 12151
  Gene Symbol: OSBPL3
  Gene Name: oxysterol binding protein-like 3
  ENSP ID: ENSP00000407829
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSS

SEQ ID NO: 60704 - protein, 61 aa, Homo sapiens
  Payload ID: 12151
  Gene Symbol: OSBPL3
  Gene Name: oxysterol binding protein-like 3
  ENSP ID: ENSP00000411249
MMSDEKNLGVSQKLVSPSRSTSSCSSKQGSRQDSWEVVEGLRGEMNYTQEPPVQKGFLLKK

SEQ ID NO: 60705 - protein, 879 aa, Homo sapiens
  Payload ID: 12152
  Gene Symbol: OSBPL5
  Gene Name: oxysterol binding protein-like 5
  Uniprot ID: Q9H0X9
  ENSP ID: ENSP00000263650
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKETLKAQKENYRQEKKRATRQLLSALTDPSVVIMADSLKIRGTLKSWTKLWCVLKPGVLLIYKTPKVGQWVGTVLLHCCELIERPSKKDGFCFKLFHPLDQSVWAVKGPKGESVGSITQPLPSSYLIFRAASESDGRCWLDALELALRCSSLLRLGTCKPGRDGEPGTSPDASPSSLCGLPASATVHPDQDLFPLNGSSLENDAFSDKSERENPEESDTETQDHSRKTESGSDQSETPGAPVRRGTTYVEQVQEELGELGEASQVETVSEENKSLMWTLLKQLRPGMDLSRVVLPTFVLEPRSFLNKLSDYYYHADLLSRAAVEEDAYSRMKLVLRWYLSGFYKKPKGIKKPYNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 60706 - protein, 811 aa, Homo sapiens
  Payload ID: 12152
  Gene Symbol: OSBPL5
  Gene Name: oxysterol binding protein-like 5
  Uniprot ID: Q9H0X9
  ENSP ID: ENSP00000302872
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKETLKAQKENYRQEKKRATRQLLSALTDPSVVIMADSLKGPKGESVGSITQPLPSSYLIFRAASESDGRCWLDALELALRCSSLLRLGTCKPGRDGEPGTSPDASPSSLCGLPASATVHPDQDLFPLNGSSLENDAFSDKSERENPEESDTETQDHSRKTESGSDQSETPGAPVRRGTTYVEQVQEELGELGEASQVETVSEENKSLMWTLLKQLRPGMDLSRVVLPTFVLEPRSFLNKLSDYYYHADLLSRAAVEEDAYSRMKLVLRWYLSGFYKKPKGIKKPYNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 60707 - protein, 811 aa, Homo sapiens; identical to SEQ ID NO: 60706
  Payload ID: 12152
  Gene Symbol: OSBPL5
  Gene Name: oxysterol binding protein-like 5
  Uniprot ID: Q9H0X9
  ENSP ID: ENSP00000374639

SEQ ID NO: 60708 - protein, 432 aa, Homo sapiens
  Payload ID: 12152
  Gene Symbol: OSBPL5
  Gene Name: oxysterol binding protein-like 5
  ENSP ID: ENSP00000431412
YNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 60709 - protein, 89 aa, Homo sapiens
  Payload ID: 12152
  Gene Symbol: OSBPL5
  Gene Name: oxysterol binding protein-like 5
  ENSP ID: ENSP00000432507
MKEEAFLRRRFSLCPPSSTPQKVDPRKLTRNLLLSGDNELYPLSPGKDMEPNGPSLPRDEGPPTPSSATKVPPAEYRLCNGSDKECVSP

SEQ ID NO: 60710 - protein, 69 aa, Homo sapiens
  Payload ID: 12152
  Gene Symbol: OSBPL5
  Gene Name: oxysterol binding protein-like 5
  ENSP ID: ENSP00000433222
MKEEAFLRRRFSLCPPSSTPQKVDPRKLTRNLLLSGDNELYPLSPGKDMEPNGPSLPRDEGPPTPSSAT

SEQ ID NO: 60711 - protein, 790 aa, Homo sapiens
  Payload ID: 12152
  Gene Symbol: OSBPL5
  Gene Name: oxysterol binding protein-like 5
  Uniprot ID: Q9H0X9
  ENSP ID: ENSP00000433342
MEPNGPSLPRDEGPPTPSSATKVPPAEYRLCNGSDKECVSPTARVTKKETLKAQKENYRQEKKRATRQLLSALTDPSVVIMADSLKIRGTLKSWTKLWCVLKPGVLLIYKTPKGPKGESVGSITQPLPSSYLIFRAASESDGRCWLDALELALRCSSLLRLGTCKPGRDGEPGTSPDASPSSLCGLPASATVHPDQDLFPLNGSSLENDAFSDKSERENPEESDTETQDHSRKTESGSDQSETPGAPVRRGTTYVEQVQEELGELGEASQVETVSEENKSLMWTLLKQLRPGMDLSRVVLPTFVLEPRSFLNKLSDYYYHADLLSRAAVEEDAYSRMKLVLRWYLSGFYKKPKGIKKPYNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 60712 - protein, 124 aa, Homo sapiens
  Payload ID: 12152
  Gene Symbol: OSBPL5
  Gene Name: oxysterol binding protein-like 5
  ENSP ID: ENSP00000433754
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKETLKAQKENYRQEKKRATRQLLSALTDP

SEQ ID NO: 60713 - protein, 115 aa, Homo sapiens
  Payload ID: 12152
  Gene Symbol: OSBPL5
  Gene Name: oxysterol binding protein-like 5
  ENSP ID: ENSP00000434265
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKETLKAQKENYRQEKNRAPS

SEQ ID NO: 60714 - protein, 98 aa, Homo sapiens
  Payload ID: 12152
  Gene Symbol: OSBPL5
  Gene Name: oxysterol binding protein-like 5
  ENSP ID: ENSP00000435812
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKET

SEQ ID NO: 60715 - protein, 139 aa, Homo sapiens
  Payload ID: 12152
  Gene Symbol: OSBPL5
  Gene Name: oxysterol binding protein-like 5
  ENSP ID: ENSP00000436950
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKETLKAQKENYRQEKKRATRQLLSALTDPSVVIMADSLKIRGTL

SEQ ID NO: 60716 - protein, 333 aa, Homo sapiens
  Payload ID: 12152
  Gene Symbol: OSBPL5
  Gene Name: oxysterol binding protein-like 5
  ENSP ID: ENSP00000437141
MTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 60717 - protein, 934 aa, Homo sapiens
  Payload ID: 12153
  Gene Symbol: OSBPL6
  Gene Name: oxysterol binding protein-like 6
  Uniprot ID: Q9BZF3
  ENSP ID: ENSP00000190611
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQANCVDISKKDKRVTRRWRTKSVSKDTKIQLQVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQALNQNAELRSRLNRIHSESIICDQVVSVNIIPSPDEAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 60718 - protein, 938 aa, Homo sapiens
  Payload ID: 12153
  Gene Symbol: OSBPL6
  Gene Name: oxysterol binding protein-like 6
  Uniprot ID: Q9BZF3
  ENSP ID: ENSP00000318723
MHQLSLIRGNRGRSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQANCVDISKKDKRVTRRWRTKSVSKDTKIQLQEGPPAKGQFSTTRRRQRLAAAVATTVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQALNQNAELRSRLNRIHSESIICDQVVSVNIIPSPDEAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 60719 - protein, 508 aa, Homo sapiens
  Payload ID: 12153
  Gene Symbol: OSBPL6
  Gene Name: oxysterol binding protein-like 6
  Uniprot ID: Q9BZF3
  ENSP ID: ENSP00000349591
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQAGEQIHVSLPLSQQVANESRLSMSESVSEFFDAQEVLLSASSSENEASDDESYISDVSDNISEDNTSVADNISRQSMHHLSFQVVLSTCQIATRRLNEQAFPLPRHPHPC

SEQ ID NO: 60720 - protein, 898 aa, Homo sapiens
  Payload ID: 12153
  Gene Symbol: OSBPL6
  Gene Name: oxysterol binding protein-like 6
  Uniprot ID: Q9BZF3
  ENSP ID: ENSP00000352713
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQANCVDISKKDKRVTRRWRTKSVSKDTKIQLQVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 60721 - protein, 959 aa, Homo sapiens
  Payload ID: 12153
  Gene Symbol: OSBPL6
  Gene Name: oxysterol binding protein-like 6
  Uniprot ID: Q9BZF3
  ENSP ID: ENSP00000376293
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQANCVDISKKDKRVTRRWRTKSVSKDTKIQLQEGPPAKGQFSTTRRRQRLAAAVATTVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQALNQNAELRSRLNRIHSESIICDQVVSVNIIPSPDEAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 60722 - protein, 898 aa, Homo sapiens; identical to SEQ ID NO: 60720
  Payload ID: 12153
  Gene Symbol: OSBPL6
  Gene Name: oxysterol binding protein-like 6
  Uniprot ID: Q9BZF3
  ENSP ID: ENSP00000386885

SEQ ID NO: 60723 - protein, 903 aa, Homo sapiens
  Payload ID: 12153
  Gene Symbol: OSBPL6
  Gene Name: oxysterol binding protein-like 6
  Uniprot ID: Q9BZF3
  ENSP ID: ENSP00000387248
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQALNQNAELRSRLNRIHSESIICDQVVSVNIIPSPDEAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 60724 - protein, 842 aa, Homo sapiens
  Payload ID: 12154
  Gene Symbol: OSBPL7
  Gene Name: oxysterol binding protein-like 7
  Uniprot ID: Q9BZF2
  ENSP ID: ENSP00000007414
MDFQERDPPFLPESAQSSKPSSAQQASELWEVVEEPRVRLGTEGVMPERQEGHLLKKRKWPLKGWHKRYFVLEDGILHYATTRQDITKGKLHGSIDVRLSVMSINKKAQRIDLDTEDNIYHLKIKSQDLFQSWVAQLRAHRLAHRLDMPRGSLPSTAHRKVPGAQLPTAATASALPGLGPREKVSSWLRDSDGLDRCSHELSECQGKLQELHRLLQSLESLHRIPSAPVIPTHQASVTTERPKKGKRTSRMWCTQSFAKDDTIGRVGRLHGSVPNLSRYLESRDSSGTRGLPPTDYAHLQRSFWALAQKVHSSLSSVLAALTMERDQLRDMHQGSELSRMGVSEASTGQRRLHSLSTSSDTTADSFSSLNPEEQEALYMKGRELTPQLSQTSILSLADSHTEFFDACEVLLSASSSENEGSEEEESCTSEITTSLSEEMLDLRGAERCQKGGCVPGRPMGPPRRRCLPAASGPGADVSLWNILRNNIGKDLSKVSMPVQLNEPLNTLQRLCEELEYSSLLDQASRIADPCERMVYIAAFAVSAYSSTYHRAGCKPFNPVLGETYECERPDRGFRFISEQVSHHPPISACHAESENFAFWQDMKWKNKFWGKSLEIVPVGTVNVSLPRFGDHFEWNKVTSCIHNVLSGQRWIEHYGEVLIRNTQDSSCHCKITFCKAKYWSSNVHEVQGAVLSRSGRVLHRLFGKWHEGLYRGPTPGGQCIWKPNSMPPDHERNFGFTQFALELNELTAELKRSLPSTDTRLRPDQRYLEEGNIQAAEAQKRRIEQLQRDRRKVMEENNIVHQARFFRRQTDSSGKEWWVTNNTYWRLRAEPGYGNMDGAVLW

SEQ ID NO: 60725 - protein, 842 aa, Homo sapiens; identical to SEQ ID NO: 60724
  Payload ID: 12154
  Gene Symbol: OSBPL7
  Gene Name: oxysterol binding protein-like 7
  Uniprot ID: Q9BZF2
  ENSP ID: ENSP00000376295

SEQ ID NO: 60726 - protein, 420 aa, Homo sapiens
  Payload ID: 12154
  Gene Symbol: OSBPL7
  Gene Name: oxysterol binding protein-like 7
  ENSP ID: ENSP00000463599
MDFQERDPPFLPESAQSSKPSSAQQASELWEVVEEPRVRLGTEGVMPERQEGHLLKKRKWPLKGWHKRYFVLEDGILHYATTRQDITKGKLHGSIDVRLSVMSINKKAQRIDLDTEDNIYHLKIKSQDLFQSWVAQLRAHRLAHRLDMPRGSLPSTAHRKVPGAQLPTAATASALPGLGPREKVSSWLRDSDGLDRCSHELSECQGKLQELHRLLQSLESLHRIPSAPVIPTHQASVTTERPKKGKRTSRMWCTQSFAKDDTIGRVGRLHGSVPNLSRYLESRDSSGTRGLPPTDYAHLQRSFWALAQKVHSSLSSVLAALTMERDQLRDMHQGSELSRMGVSEASTGQRRLHSLSTSSDTTADSFSSLNPEEQEALYMKGRELTPQLSQTSILSLADSHTEFFDACEVLLSASSSENEG

SEQ ID NO: 60727 - protein, 19 aa, Homo sapiens
  Payload ID: 12154
  Gene Symbol: OSBPL7
  Gene Name: oxysterol binding protein-like 7
  ENSP ID: ENSP00000464624
RGPTPGGQCIWKPICLGAE

SEQ ID NO: 60728 - protein, 357 aa, Homo sapiens
  Payload ID: 12154
  Gene Symbol: OSBPL7
  Gene Name: oxysterol binding protein-like 7
  Uniprot ID: Q9BZF2
  ENSP ID: ENSP00000479827
MDFQERDPPFLPESAQSSKPSSAQQASELWEVVEEPRVRLGTEGVMPERQEGHLLKKRKWPLKGWHKRYFVLEDGILHYATTRQDITKGKLHGSIDVRLSVMSINKKAQRIDLDTEDNIYHLKIKSQDLFQSWVAQLRAHRLAHRLDMPRGSLPSTAHRKVPGAQLPTAATASALPGLGPREKVSSWLRDSDGLDRCSHELSECQGKLQELHRLLQSLESLHRIPSAPVIPTHQASVTTERPKKGKRTSRMWCTQSFAKDDTIGRVGRLHGSVPNLSRYLESRDSSGTRGLPPTDYAHLQRSFWALAQKVHSSLSSVLAALTMERDQLRDMHQGSELSRMGVRPGGQGDWCGERASS

SEQ ID NO: 60729 - protein, 889 aa, Homo sapiens
  Payload ID: 12155
  Gene Symbol: OSBPL8
  Gene Name: oxysterol binding protein-like 8
  Uniprot ID: Q9BZF1
  ENSP ID: ENSP00000261183
MEGGLADGEPDRTSLLGDSKDVLGPSTVVANSDESQLLTPGKMSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEEWSCKLFELDPLTGEWHYKFADTRPWDPLNDMIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 60730 - protein, 847 aa, Homo sapiens
  Payload ID: 12155
  Gene Symbol: OSBPL8
  Gene Name: oxysterol binding protein-like 8
  Uniprot ID: Q9BZF1
  ENSP ID: ENSP00000376939
MSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEEWSCKLFELDPLTGEWHYKFADTRPWDPLNDMIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 60731 - protein, 847 aa, Homo sapiens; identical to SEQ ID NO: 60730
  Payload ID: 12155
  Gene Symbol: OSBPL8
  Gene Name: oxysterol binding protein-like 8
  Uniprot ID: Q9BZF1
  ENSP ID: ENSP00000376940

SEQ ID NO: 60732 - protein, 157 aa, Homo sapiens
  Payload ID: 12155
  Gene Symbol: OSBPL8
  Gene Name: oxysterol binding protein-like 8
  ENSP ID: ENSP00000446886
MLLGDSKDVLGPSTVVANSDESQLLTPGKMSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCV

SEQ ID NO: 60733 - protein, 52 aa, Homo sapiens
  Payload ID: 12155
  Gene Symbol: OSBPL8
  Gene Name: oxysterol binding protein-like 8
  ENSP ID: ENSP00000447235
MEGGLADGEPDRTSLLGDSKDVLGPSTNSDESQLLTPGKMSQRQGKEAYPTP

SEQ ID NO: 60734 - protein, 28 aa, Homo sapiens
  Payload ID: 12155
  Gene Symbol: OSBPL8
  Gene Name: oxysterol binding protein-like 8
  ENSP ID: ENSP00000447483
MEGGLADGEPDRTSSESKLYNGSEKDSS

SEQ ID NO: 60735 - protein, 58 aa, Homo sapiens
  Payload ID: 12155
  Gene Symbol: OSBPL8
  Gene Name: oxysterol binding protein-like 8
  ENSP ID: ENSP00000447744
MEGGLADGEPDRTSLLGDSKDVLGPSTVVANSDESQLLTPGKMSQRQGKEAYPTPTKD

SEQ ID NO: 60736 - protein, 694 aa, Homo sapiens
  Payload ID: 12155
  Gene Symbol: OSBPL8
  Gene Name: oxysterol binding protein-like 8
  ENSP ID: ENSP00000447893
MKEESSQRRFSSCTGVLPVLFPPRIDGRKLVRNASFGGYNELSPSLPGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARD

SEQ ID NO: 60737 - protein, 41 aa, Homo sapiens
  Payload ID: 12155
  Gene Symbol: OSBPL8
  Gene Name: oxysterol binding protein-like 8
  ENSP ID: ENSP00000448394
MEGGLADGEPDRTSVLKEGRKIFLKIKMNLHFLCQRASLNL

SEQ ID NO: 60738 - protein, 111 aa, Homo sapiens
  Payload ID: 12155
  Gene Symbol: OSBPL8
  Gene Name: oxysterol binding protein-like 8
  ENSP ID: ENSP00000449618
MSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMAD

SEQ ID NO: 60739 - protein, 76 aa, Homo sapiens
  Payload ID: 12155
  Gene Symbol: OSBPL8
  Gene Name: oxysterol binding protein-like 8
  ENSP ID: ENSP00000449919
MSQRQGKEAYPTPTKDLHQPSLSPASPHSQGFERGKEDISQNKDESSLSMSKSKSESKLYNGSEKDSSTSSKLTKK

SEQ ID NO: 60740 - protein, 721 aa, Homo sapiens
  Payload ID: 12155
  Gene Symbol: OSBPL8
  Gene Name: oxysterol binding protein-like 8
  ENSP ID: ENSP00000450238
MEGGLADGEPDRTSLLGDSKDVLGPSTVVANSDESQLLTPGKMSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRK

SEQ ID NO: 60741 - protein, 847 aa, Homo sapiens; identical to SEQ ID NO: 60730
  Payload ID: 12155
  Gene Symbol: OSBPL8
  Gene Name: oxysterol binding protein-like 8
  Uniprot ID: Q9BZF1
  ENSP ID: ENSP00000478240

SEQ ID NO: 60742 - protein, 626 aa, Homo sapiens
  Payload ID: 12156
  Gene Symbol: OSBPL9
  Gene Name: oxysterol binding protein-like 9
  Uniprot ID: Q96SU4
  ENSP ID: ENSP00000354970
MAFLLATCGGLDSGFVPSVQDFDKKLTEADAYLQILIEQLKLFDDKLQNCKEDEQRKKIETLKETTNSMVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 60743 - protein, 723 aa, Homo sapiens
  Payload ID: 12156
  Gene Symbol: OSBPL9
  Gene Name: oxysterol binding protein-like 9
  Uniprot ID: Q96SU4
  ENSP ID: ENSP00000360779
MASIMEGPLSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 60744 - protein, 116 aa, Homo sapiens
  Payload ID: 12156
  Gene Symbol: OSBPL9
  Gene Name: oxysterol binding protein-like 9
  ENSP ID: ENSP00000390113
MASIMEGPLSKWTNVMKGWQYRWFVLDYNAGLLSYYTSKDKMMRGSRRGCVRLRGAVIGIDDEDDSTFTITVDQKTFHFQGELKEEILSLHSPICFFSSLLGCLLDDLNGFATDPA

SEQ ID NO: 60745 - protein, 736 aa, Homo sapiens
  Payload ID: 12156
  Gene Symbol: OSBPL9
  Gene Name: oxysterol binding protein-like 9
  Uniprot ID: Q96SU4
  ENSP ID: ENSP00000407168
MASIMEGPLSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKDQSNAEKHADGMISTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 60746 - protein, 746 aa, Homo sapiens
  Payload ID: 12156
  Gene Symbol: OSBPL9
  Gene Name: oxysterol binding protein-like 9
  Uniprot ID: Q96SU4
  ENSP ID: ENSP00000412733
MASIMEGPLSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQISTTLAFFQSSGISPVLEFSKIIGLDSGFVPSVQDFDKKLTEADAYLQILIEQLKLFDDKLQNCKEDEQRKKIETLKETTNSMVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 60747 - protein, 719 aa, Homo sapiens
  Payload ID: 12156
  Gene Symbol: OSBPL9
  Gene Name: oxysterol binding protein-like 9
  Uniprot ID: Q96SU4
  ENSP ID: ENSP00000413263
MASIMEGPLSKWTNVMKGWQYRWFVLDYNAGLLSYYTGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKDQSNAEKHADGMISTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 60748 - protein, 79 aa, Homo sapiens
  Payload ID: 12156
  Gene Symbol: OSBPL9
  Gene Name: oxysterol binding protein-like 9
  ENSP ID: ENSP00000431274
MAFLLATCGGLDSGFVPSVQDFDKKLTEADAYLQILIEQLKLFDDKLQNCKEDEQRKKIETLKETTNRWDSAMLPRLVS

SEQ ID NO: 60749 - protein, 558 aa, Homo sapiens
  Payload ID: 12156
  Gene Symbol: OSBPL9
  Gene Name: oxysterol binding protein-like 9
  Uniprot ID: Q96SU4
  ENSP ID: ENSP00000431980
MVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 60750 - protein, 34 aa, Homo sapiens
  Payload ID: 12156
  Gene Symbol: OSBPL9
  Gene Name: oxysterol binding protein-like 9
  ENSP ID: ENSP00000432409
ESIKHCIVLLQIAKDQSNAEKHADGMILYCVSLF

SEQ ID NO: 60751 - protein, 109 aa, Homo sapiens
  Payload ID: 12156
  Gene Symbol: OSBPL9
  Gene Name: oxysterol binding protein-like 9
  ENSP ID: ENSP00000432801
MVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFS

SEQ ID NO: 60752 - protein, 571 aa, Homo sapiens
  Payload ID: 12156
  Gene Symbol: OSBPL9
  Gene Name: oxysterol binding protein-like 9
  Uniprot ID: Q96SU4
  ENSP ID: ENSP00000433083
MVESIKHCIVLLQIAKDQSNAEKHADGMISTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 60753 - protein, 558 aa, Homo sapiens; identical to SEQ ID NO: 60749
  Payload ID: 12156
  Gene Symbol: OSBPL9
  Gene Name: oxysterol binding protein-like 9
  Uniprot ID: Q96SU4
  ENSP ID: ENSP00000433279

SEQ ID NO: 60754 - protein, 116 aa, Homo sapiens
  Payload ID: 12156
  Gene Symbol: OSBPL9
  Gene Name: oxysterol binding protein-like 9
  ENSP ID: ENSP00000433291
  MOD_RES (1)..(1): Any amino acid
XDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIEPV

SEQ ID NO: 60755 - protein, 196 aa, Homo sapiens
  Payload ID: 12156
  Gene Symbol: OSBPL9
  Gene Name: oxysterol binding protein-like 9
  ENSP ID: ENSP00000434798
ASIMEGPLSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKAVAIHHRVAVSLLQAT

SEQ ID NO: 60756 - protein, 92 aa, Homo sapiens
  Payload ID: 12156
  Gene Symbol: OSBPL9
  Gene Name: oxysterol binding protein-like 9
  ENSP ID: ENSP00000435129
MVESIKHCIVLLQIAKDQSNAEKHADGMISTINPVDAIYQPSPLEPVISTMPSQTVLPPEPVQLCKSEQRPSSLPVGPVLATLGHHQTPTPN

SEQ ID NO: 60757 - protein, 32 aa, Homo sapiens
  Payload ID: 12156
  Gene Symbol: OSBPL9
  Gene Name: oxysterol binding protein-like 9
  ENSP ID: ENSP00000435247
MVESIKHCIVLLQIAKDQSNAEKHADGMIVSL

SEQ ID NO: 60758 - protein, 74 aa, Homo sapiens
  Payload ID: 12156
  Gene Symbol: OSBPL9
  Gene Name: oxysterol binding protein-like 9
  ENSP ID: ENSP00000435264
  MOD_RES (1)..(1): Any amino acid
XSLAAPKMASIMEGPLSKWTNVMKGWQYRWFVLDYNAGLLSYYTSKDKMMRGSRRGCVRLRPVMLMSERSGSMP

SEQ ID NO: 60759 - protein, 79 aa, Homo sapiens; identical to SEQ ID NO: 60748
  Payload ID: 12156
  Gene Symbol: OSBPL9
  Gene Name: oxysterol binding protein-like 9
  ENSP ID: ENSP00000435429

SEQ ID NO: 60760 - protein, 41 aa, Homo sapiens
  Payload ID: 12156
  Gene Symbol: OSBPL9
  Gene Name: oxysterol binding protein-like 9
  ENSP ID: ENSP00000435627
MVESIKHCIVLLQIAKSTILVRNLLVLPLVLVCMGCHNKIP

SEQ ID NO: 60761 - protein, 129 aa, Homo sapiens
  Payload ID: 12156
  Gene Symbol: OSBPL9
  Gene Name: oxysterol binding protein-like 9
  ENSP ID: ENSP00000485521
EIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 60762 - protein, 389 aa, Homo sapiens
  Payload ID: 12157
  Gene Symbol: OXTR
  Gene Name: oxytocin receptor
  Uniprot ID: P30559
  ENSP ID: ENSP00000324270
MEGALAANWSAEAANASAAPPGAEGNRTAGPPRRNEALARVEVAVLCLILLLALSGNACVLLALRTTRQKHSRLFFFMKHLSIADLVVAVFQVLPQLLWDITFRFYGPDLLCRLVKYLQVVGMFASTYLLLLMSLDRCLAICQPLRSLRRRTDRLAVLATWLGCLVASAPQVHIFSLREVADGVFDCWAVFIQPWGPKAYITWITLAVYIVPVIVLAACYGLISFKIWQNLRLKTAAAAAAEAPEGAAAGDGGRVALARVSSVKLISKAKIRTVKMTFIIVLAFIVCWTPFFFVQMWSVWDANAPKEASAFIIVMLLASLNSCCNPWIYMLFTGHLFHELVQRFLCCSASYLKGRRLGETSASKKSNSSSFVLSHRSSSQRSCSQPSTA

SEQ ID NO: 60763 - protein, 92 aa, Homo sapiens
  Payload ID: 12157
  Gene Symbol: OXTR
  Gene Name: oxytocin receptor
  ENSP ID: ENSP00000389587
MEGALAANWSAEAANASAAPPGAEGNRTAGPPRRNEALARVEVAVLCLILLLALSGNACVLLALRTTRQKHSRLFFFMKHLSIADLVVAVFQ

SEQ ID NO: 60764 - protein, 43 aa, Homo sapiens
  Payload ID: 12157
  Gene Symbol: OXTR
  Gene Name: oxytocin receptor
  ENSP ID: ENSP00000414828
MEGALAANWSAEAANASAAPPGAEGNRTAGPPRRNEALARVEV

SEQ ID NO: 60765 - protein, 125 aa, Homo sapiens
  Payload ID: 12158
  Gene Symbol: OXT
  Gene Name: oxytocin/neurophysin I prepropeptide
  Uniprot ID: P01178
  ENSP ID: ENSP00000217386
MAGPSLACCLLGLLALTSACYIQNCPLGGKRAAPDLDVRKCLPCGPGGKGRCFGPNICCAEELGCFVGTAEALRCQEENYLPSPCQSGQKACGSGGRCAVLGLCCSPDGCHADPACDAEATFSQR

SEQ ID NO: 60766 - protein, 146 aa, Homo sapiens
  Payload ID: 12159
  Gene Symbol: PAGE1
  Gene Name: P antigen family, member 1 (prostate associated)
  Uniprot ID: O75459
  ENSP ID: ENSP00000365320
MGFLRRLIYRRRPMIYVESSEESSDEQPDEVESPTQSQDSTPAEEREDEGASAAQGQEPEADSQELVQPKTGCELGDGPDTKRVCLRNEEQMKLPAEGPEPEADSQEQVHPKTGCERGDGPDVQELGLPNPEEVKTPEEDEGQSQP

SEQ ID NO: 60767 - protein, 94 aa, Homo sapiens
  Payload ID: 12160
  Gene Symbol: PAGE2
  Gene Name: P antigen family, member 2 (prostate associated)
  ENSP ID: ENSP00000364104
MSELLRARSQSSERGNDQESSQPVGSVIVQEPTEEKRQEEEPPTDNQGPDMEAFQQELALLKIEDEPGDGPDVREGIMPTFDLTKVLEAGDAQP

SEQ ID NO: 60768 - protein, 111 aa, Homo sapiens
  Payload ID: 12160
  Gene Symbol: PAGE2
  Gene Name: P antigen family, member 2 (prostate associated)
  Uniprot ID: Q7Z2X7
  ENSP ID: ENSP00000364107
MSELLRARSQSSERGNDQESSQPVGSVIVQEPTEEKRQEEEPPTDNQGIAPSGEIENQAVPAFQGPDMEAFQQELALLKIEDEPGDGPDVREGIMPTFDLTKVLEAGDAQP

SEQ ID NO: 60769 - protein, 64 aa, Homo sapiens
  Payload ID: 12160
  Gene Symbol: PAGE2
  Gene Name: P antigen family, member 2 (prostate associated)
  ENSP ID: ENSP00000392976
MSELLRARSQSSERGNDQESSQPVGSVIVQEPTEEKRQEEEPPTDNQGIAPSGEIENQAVPAFQ

SEQ ID NO: 60770 - protein, 111 aa, Homo sapiens
  Payload ID: 12161
  Gene Symbol: PAGE2B
  Gene Name: P antigen family, member 2B
  Uniprot ID: Q5JRK9
  ENSP ID: ENSP00000364110
MSEHVRTRSQSSERGNDQESSQPVGSVIVQEPTEEKRQEEEPPTDNQGIAPSGEIENEGAPAVQGPDMEAFQQELALLKIEDEPGDGPDVREGIMPTFDLTKVLEAGDAQP

SEQ ID NO: 60771 - protein, 94 aa, Homo sapiens
  Payload ID: 12161
  Gene Symbol: PAGE2B
  Gene Name: P antigen family, member 2B
  ENSP ID: ENSP00000364113
MSEHVRTRSQSSERGNDQESSQPVGSVIVQEPTEEKRQEEEPPTDNQGPDMEAFQQELALLKIEDEPGDGPDVREGIMPTFDLTKVLEAGDAQP

SEQ ID NO: 60772 - protein, 113 aa, Homo sapiens
  Payload ID: 12162
  Gene Symbol: PAGE3
  Gene Name: P antigen family, member 3 (prostate associated)
  Uniprot ID: Q5JUK9
  ENSP ID: ENSP00000364089
MSGHQRTRSRSRERRDDQDSNHPVGAVVAQELPSNDQLQQEEPPIESQDYTPGQERDEGALDFQVLGLAAYLWELTRSKTGGERGDGPNVKGEFLPNLEPVKIPEAGEGQPSV

SEQ ID NO: 60773 - protein, 113 aa, Homo sapiens; identical to SEQ ID NO: 60772
  Payload ID: 12162
  Gene Symbol: PAGE3
  Gene Name: P antigen family, member 3 (prostate associated)
  Uniprot ID: Q5JUK9
  ENSP ID: ENSP00000429571

SEQ ID NO: 60774 - protein, 102 aa, Homo sapiens
  Payload ID: 12163
  Gene Symbol: PAGE4
  Gene Name: P antigen family, member 4 (prostate associated)
  Uniprot ID: O60829
  ENSP ID: ENSP00000218068
MSARVRSRSRGRGDGQEAPDVVAFVAPGESQQEEPPTDNQDIEPGQEREGTPPIEERKVEGDCQEMDLEKTRSERGDGSDVKEKTPPNPKHAKTKEAGDGQP

SEQ ID NO: 60775 - protein, 102 aa, Homo sapiens; identical to SEQ ID NO: 60774
  Payload ID: 12163
  Gene Symbol: PAGE4
  Gene Name: P antigen family, member 4 (prostate associated)
  Uniprot ID: O60829
  ENSP ID: ENSP00000365311

SEQ ID NO: 60776 - protein, 130 aa, Homo sapiens
  Payload ID: 12164
  Gene Symbol: PAGE5
  Gene Name: P antigen family, member 5 (prostate associated)
  Uniprot ID: Q96GU1
  ENSP ID: ENSP00000289619
MQAPWAGNRGWAGTREEVRDMSEHVTRSQSSERGNDQESSQPVGPVIVQQPTEEKRQEEEPPTDNQGIAPSGEIKNEGAPAVQGTDVEAFQQELALLKIEDAPGDGPDVREGTLPTFDPTKVLEAGEGQL

SEQ ID NO: 60777 - protein, 93 aa, Homo sapiens
  Payload ID: 12164
  Gene Symbol: PAGE5
  Gene Name: P antigen family, member 5 (prostate associated)
  ENSP ID: ENSP00000364090
MSEHVTRSQSSERGNDQESSQPVGPVIVQQPTEEKRQEEEPPTDNQGTDVEAFQQELALLKIEDAPGDGPDVREGTLPTFDPTKVLEAGEGQL

SEQ ID NO: 60778 - protein, 110 aa, Homo sapiens
  Payload ID: 12164
  Gene Symbol: PAGE5
  Gene Name: P antigen family, member 5 (prostate associated)
  Uniprot ID: Q96GU1
  ENSP ID: ENSP00000364093
MSEHVTRSQSSERGNDQESSQPVGPVIVQQPTEEKRQEEEPPTDNQGIAPSGEIKNEGAPAVQGTDVEAFQQELALLKIEDAPGDGPDVREGTLPTFDPTKVLEAGEGQL

SEQ ID NO: 60779 - protein, 553 aa, Homo sapiens
  Payload ID: 12165
  Gene Symbol: PAK1
  Gene Name: p21 protein (Cdc42/Rac)-activated kinase 1
  Uniprot ID: Q13153
  ENSP ID: ENSP00000278568
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARLLQTSNITKSEQKKNPQAVLDVLEFYNSKKTSNSQKYMSFTDKSAEDYNSSNALNVKAVSETPAVPPVSEDEDDDDDDATPPPVIAPRPEHTKSVYTRSVIEPLPVTPTRDVATSPISPTENNTTPPDALTRNTEKQKKKPKMSDEEILEKLRSIVSVGDPKKKYTRFEKIGQGASGTVYTAMDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQVRKLRFQVFSNFSMIAASIPEDCQAPLQPHSTDCCS

SEQ ID NO: 60780 - protein, 545 aa, Homo sapiens
  Payload ID: 12165
  Gene Symbol: PAK1
  Gene Name: p21 protein (Cdc42/Rac)-activated kinase 1
  Uniprot ID: Q13153
  ENSP ID: ENSP00000348696
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARLLQTSNITKSEQKKNPQAVLDVLEFYNSKKTSNSQKYMSFTDKSAEDYNSSNALNVKAVSETPAVPPVSEDEDDDDDDATPPPVIAPRPEHTKSVYTRSVIEPLPVTPTRDVATSPISPTENNTTPPDALTRNTEKQKKKPKMSDEEILEKLRSIVSVGDPKKKYTRFEKIGQGASGTVYTAMDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQHQFLKIAKPLSSLTPLIAAAKEATKNNH

SEQ ID NO: 60781 - protein, 244 aa, Homo sapiens
  Payload ID: 12165
  Gene Symbol: PAK1
  Gene Name: p21 protein (Cdc42/Rac)-activated kinase 1
  ENSP ID: ENSP00000431541
  MOD_RES (1)..(1): Any amino acid
XASGTVYTAMDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQALVSG

SEQ ID NO: 60782 - protein, 167 aa, Homo sapiens
  Payload ID: 12165
  Gene Symbol: PAK1
  Gene Name: p21 protein (Cdc42/Rac)-activated kinase 1
  ENSP ID: ENSP00000431906
  MOD_RES (1)..(1): Any amino acid
XNITKSEQKKNPQAVLDVLEFYNSKKTSNSQKYMSFTDKSAEDYNSSNALNVKAVSETPAVPPVSEDEDDDDDDATPPPVIAPRPEHTKSVYTRSVIEPLPVTPTRDVATSPISPTENNTTPPDALTRNTEKQKKKPKMSDEEILEKLLTSWEMSCGLLWNTWLEAP

SEQ ID NO: 60783 - protein, 99 aa, Homo sapiens
  Payload ID: 12165
  Gene Symbol: PAK1
  Gene Name: p21 protein (Cdc42/Rac)-activated kinase 1
  ENSP ID: ENSP00000432477
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGM

SEQ ID NO: 60784 - protein, 89 aa, Homo sapiens
  Payload ID: 12165
  Gene Symbol: PAK1
  Gene Name: p21 protein (Cdc42/Rac)-activated kinase 1
  ENSP ID: ENSP00000433004
MSNNGLDIQDKPPAPPMRNTSTMIGAGSKDAGTLNHGSKPLPPNPEEKKKKDRFYRSILPGDKTNKKKEKERPEISLPSDFEHTIHVGF

SEQ ID NO: 60785 - protein, 455 aa, Homo sapiens
  Payload ID: 12165
  Gene Symbol: PAK1
  Gene Name: p21 protein (Cdc42/Rac)-activated kinase 1
  ENSP ID: ENSP00000433211
MPEQWARLLQTSNITKSEQKKNPQAVLDVLEFYNSKKTSNSQKYMSFTDKSAEDYNSSNALNVKAVSETPAVPPVSEDEDDDDDDATPPPVIAPRPEHTKSVYTRSVIEPLPVTPTRDVATSPISPTENNTTPPDALTRNTEKQKKKPKMSDEEILEKLRSIVSVGDPKKKYTRFEKIGQGASGTVYTAMDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQVRKLRFQVFSNFSMIAASIPEDCQAPLQPHSTDCCS

SEQ ID NO: 60786 - protein, 522 aa, Homo sapiens
  Payload ID: 12165
  Gene Symbol: PAK1
  Gene Name: p21 protein (Cdc42/Rac)-activated kinase 1
  ENSP ID: ENSP00000433423
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARLLQTSNITKSEQKKNPQAVLDVLEFYNSKKTSNSQKYMSFTDKSAEDYNSSNALNVKAVSETPAVPPVSEDEDDDDDDATPPPVIAPRPEHTKSVYTRSVIEPLPVTPTRDVATSPISPTENNTTPPDALTRNTEKQKKKPKMSDEEILEKLRSIVSVGDPKKKYTRFEKIGQGASGTVYTAMDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQHSSRL

SEQ ID NO: 60787 - protein, 106 aa, Homo sapiens
  Payload ID: 12165
  Gene Symbol: PAK1
  Gene Name: p21 protein (Cdc42/Rac)-activated kinase 1
  ENSP ID: ENSP00000433518
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARL

SEQ ID NO: 60788 - protein, 26 aa, Homo sapiens
  Payload ID: 12165
  Gene Symbol: PAK1
  Gene Name: p21 protein (Cdc42/Rac)-activated kinase 1
  ENSP ID: ENSP00000433737
MSNNGLDIQDKPPAPPMRNTSTMIGA

SEQ ID NO: 60789 - protein, 63 aa, Homo sapiens
  Payload ID: 12165
  Gene Symbol: PAK1
  Gene Name: p21 protein (Cdc42/Rac)-activated kinase 1
  ENSP ID: ENSP00000435983
MSNNGLDIQDKPPAPPMRNTSTMIGAGSKDAGTLNHGSKPLPPNPEEKKKKDRFYRSILPGDK

SEQ ID NO: 60790 - protein, 18 aa, Homo sapiens
  Payload ID: 12165
  Gene Symbol: PAK1
  Gene Name: p21 protein (Cdc42/Rac)-activated kinase 1
  ENSP ID: ENSP00000437261
KSLLESMGCSQSLWPLSR

SEQ ID NO: 60791 - protein, 524 aa, Homo sapiens
  Payload ID: 12166
  Gene Symbol: PAK2
  Gene Name: p21 protein (Cdc42/Rac)-activated kinase 2
  Uniprot ID: Q13177
  ENSP ID: ENSP00000314067
MSDNGELEDKPPAPPVRMSSTIFSTGGKDPLSANHSLKPLPSVPEEKKPRHKIISIFSGTEKGSKKKEKERPEISPPSDFEHTIHVGFDAVTGEFTGMPEQWARLLQTSNITKLEQKKNPQAVLDVLKFYDSNTVKQKYLSFTPPEKDGFPSGTPALNAKGTEAPAVVTEEEDDDEETAPPVIAPRPDHTKSIYTRSVIDPVPAPVGDSHVDGAAKSLDKQKKKTKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKPLSSLTPLIMAAKEAMKSNR

SEQ ID NO: 60792 - protein, 221 aa, Homo sapiens
  Payload ID: 12166
  Gene Symbol: PAK2
  Gene Name: p21 protein (Cdc42/Rac)-activated kinase 2
  ENSP ID: ENSP00000402927
  MOD_RES (1)..(1): Any amino acid
XASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRHPFLKLAKPLSSLTPLIMAAKEAMKSNR

SEQ ID NO: 60793 - protein, 559 aa, Homo sapiens
  Payload ID: 12167
  Gene Symbol: PAK3
  Gene Name: p21 protein (Cdc42/Rac)-activated kinase 3
  Uniprot ID: O75914
  ENSP ID: ENSP00000262836
MSDGLDNEEKPPAPPLRMNSNNRDSSALNHSSKPLPMAPEEKNKKARLRSIFPGGGDKTNKKKEKERPEISLPSDFEHTIHVGFDAVTGEFTPDLYGSQMCPGKLPEGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 60794 - protein, 580 aa, Homo sapiens
  Payload ID: 12167
  Gene Symbol: PAK3
  Gene Name: p21 protein (Cdc42/Rac)-activated kinase 3
  Uniprot ID: O75914
  ENSP ID: ENSP00000353864
MSDGLDNEEKPPAPPLRMNSNNRDSSALNHSSKPLPMAPEEKNKKARLRSIFPGGGDKTNKKKEKERPEISLPSDFEHTIHVGFDAVTGEFTNSPFQTSRPVTVASSQSEGKMPDLYGSQMCPGKLPEGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 60795 - protein, 544 aa, Homo sapiens
  Payload ID: 12167
  Gene Symbol: PAK3
  Gene Name: p21 protein (Cdc42/Rac)-activated kinase 3
  Uniprot ID: O75914
  ENSP ID: ENSP00000361077
MSDGLDNEEKPPAPPLRMNSNNRDSSALNHSSKPLPMAPEEKNKKARLRSIFPGGGDKTNKKKEKERPEISLPSDFEHTIHVGFDAVTGEFTGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 60796 - protein, 559 aa, Homo sapiens; identical to SEQ ID NO: 60793
  Payload ID: 12167
  Gene Symbol: PAK3
  Gene Name: p21 protein (Cdc42/Rac)-activated kinase 3
  Uniprot ID: O75914
  ENSP ID: ENSP00000361080

SEQ ID NO: 60797 - protein, 565 aa, Homo sapiens
  Payload ID: 12167
  Gene Symbol: PAK3
  Gene Name: p21 protein (Cdc42/Rac)-activated kinase 3
  Uniprot ID: O75914
  ENSP ID: ENSP00000389172
MSDGLDNEEKPPAPPLRMNSNNRDSSALNHSSKPLPMAPEEKNKKARLRSIFPGGGDKTNKKKEKERPEISLPSDFEHTIHVGFDAVTGEFTNSPFQTSRPVTVASSQSEGKMGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 60798 - protein, 544 aa, Homo sapiens; identical to SEQ ID NO: 60795
  Payload ID: 12167
  Gene Symbol: PAK3
  Gene Name: p21 protein (Cdc42/Rac)-activated kinase 3
  Uniprot ID: O75914
  ENSP ID: ENSP00000401982

SEQ ID NO: 60799 - protein, 181 aa, Homo sapiens
  Payload ID: 12167
  Gene Symbol: PAK3
  Gene Name: p21 protein (Cdc42/Rac)-activated kinase 3
  ENSP ID: ENSP00000405642
MSDGLDNEEKPPAPPLRMNSNNRDSSALNHSSKPLPMAPEEKNKKARLRSIFPGGGDKTNKKKEKERPEISLPSDFEHTIHVGFDAVTGEFTNSPFQTSRPVTVASSQSEGKMPDLYGSQMCPGKLPEGIPEQWARLLQTSNITKLEQKKNPQAVLDVLKFYDSKETVNNQKYMSFTSGDK

SEQ ID NO: 60800 - protein, 544 aa, Homo sapiens; identical to SEQ ID NO: 60795
  Payload ID: 12167
  Gene Symbol: PAK3
  Gene Name: p21 protein (Cdc42/Rac)-activated kinase 3
  Uniprot ID: O75914
  ENSP ID: ENSP00000410853

SEQ ID NO: 60801 - protein, 580 aa, Homo sapiens; identical to SEQ ID NO: 60794
  Payload ID: 12167
  Gene Symbol: PAK3
  Gene Name: p21 protein (Cdc42/Rac)-activated kinase 3
  Uniprot ID: O75914
  ENSP ID: ENSP00000428921

SEQ ID NO: 60802 - protein, 565 aa, Homo sapiens; identical to SEQ ID NO: 60797
  Payload ID: 12167
  Gene Symbol: PAK3
  Gene Name: p21 protein (Cdc42/Rac)-activated kinase 3
  Uniprot ID: O75914
  ENSP ID: ENSP00000429113

SEQ ID NO: 60803 - protein, 543 aa, Homo sapiens
  Payload ID: 12167
  Gene Symbol: PAK3
  Gene Name: p21 protein (Cdc42/Rac)-activated kinase 3
  ENSP ID: ENSP00000484798
MSDGLDNEEKPPAPPLRMNSNPGFFSTQPQLKPLPMAPEEKNKKARLRSIFPGGGDKTNKKKEKERPEISLPSDFEHTIHVGFDAVTGEFTGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 60804 - protein, 501 aa, Homo sapiens
  Payload ID: 12168
  Gene Symbol: PAK4
  Gene Name: p21 protein (Cdc42/Rac)-activated kinase 4
  Uniprot ID: O96013
  ENSP ID: ENSP00000326864
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPATTARGGPGKGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 60805 - protein, 591 aa, Homo sapiens
  Payload ID: 12168
  Gene Symbol: PAK4
  Gene Name: p21 protein (Cdc42/Rac)-activated kinase 4
  Uniprot ID: O96013
  ENSP ID: ENSP00000351049
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPATTARGGPGKAGSRGRFAGHSEAGGGSGDRRRAGPEKRPKSSREGSGGPQESSRDKRPLSGPDVGTPQPAGLASGAKLAAGRPFNTYPRADTDHPSRGAQGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 60806 - protein, 591 aa, Homo sapiens; identical to SEQ ID NO: 60805
  Payload ID: 12168
  Gene Symbol: PAK4
  Gene Name: p21 protein (Cdc42/Rac)-activated kinase 4
  Uniprot ID: O96013
  ENSP ID: ENSP00000353625

SEQ ID NO: 60807 - protein, 591 aa, Homo sapiens; identical to SEQ ID NO: 60805
  Payload ID: 12168
  Gene Symbol: PAK4
  Gene Name: p21 protein (Cdc42/Rac)-activated kinase 4
  Uniprot ID: O96013
  ENSP ID: ENSP00000469413

SEQ ID NO: 60808 - protein, 438 aa, Homo sapiens
  Payload ID: 12168
  Gene Symbol: PAK4
  Gene Name: p21 protein (Cdc42/Rac)-activated kinase 4
  Uniprot ID: O96013
  ENSP ID: ENSP00000470284
MFGKRKKRVEISAPSNFEHRVHTGFDQHEQKFTGLPRQWQSLIEESARRPKPLVDPACITSIQPGAPKGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 60809 - protein, 438 aa, Homo sapiens; identical to SEQ ID NO: 60808
  Payload ID: 12168
  Gene Symbol: PAK4
  Gene Name: p21 protein (Cdc42/Rac)-activated kinase 4
  Uniprot ID: O96013
  ENSP ID: ENSP00000471157

SEQ ID NO: 60810 - protein, 182 aa, Homo sapiens
  Payload ID: 12168
  Gene Symbol: PAK4
  Gene Name: p21 protein (Cdc42/Rac)-activated kinase 4
  ENSP ID: ENSP00000471318
MFVGDSTWRRECPRWWRCKRAEGGARARSSRPHRVPGTMFGKRKKRVEISAPSNFEHRVHTGFDQHEQKFTGLPRQWQSLIEESARRPKPLVDPACITSIQPGAPKGEPHDVAPNGPSAGGLAIPQSSSSSSRPPTRARGAPSPGVLGPHASEPQLAPPACTPAAPAVPGPPGPRSPQREPQ

SEQ ID NO: 60811 - protein, 149 aa, Homo sapiens
  Payload ID: 12168
  Gene Symbol: PAK4
  Gene Name: p21 protein (Cdc42/Rac)-activated kinase 4
  ENSP ID: ENSP00000472061
  MOD_RES (1)..(1): Any amino acid
XIMRDYQHENVVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 60812 - protein, 131 aa, Homo sapiens
  Payload ID: 12168
  Gene Symbol: PAK4
  Gene Name: p21 protein (Cdc42/Rac)-activated kinase 4
  ENSP ID: ENSP00000472862
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPATTARGGPGK

SEQ ID NO: 60813 - protein, 93 aa, Homo sapiens
  Payload ID: 12168
  Gene Symbol: PAK4
  Gene Name: p21 protein (Cdc42/Rac)-activated kinase 4
  ENSP ID: ENSP00000473215
MFGKRKKRVEISAPSNFEHRVHTGFDQHEQKFTGLPRQWQSLIEESARRPKPLVDPACITSIQPGAPKGEPHDVAPNGPSAGGLAIPQSSSSS

SEQ ID NO: 60814 - protein, 681 aa, Homo sapiens
  Payload ID: 12169
  Gene Symbol: PAK6
  Gene Name: p21 protein (Cdc42/Rac)-activated kinase 6
  Uniprot ID: Q9NQU5
  ENSP ID: ENSP00000260404
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHWATDPDMYLQSPQSERTDPHGLYLSCNGGTPAGHKQMPWPEPQSPRVLPNGLAAKAQSLGPAEFQGASQRCLQLGACLQSSPPGASPPTGTNRHGMKAAKHGSEEARPQSCLVGSATGRPGGEGSPSPKTRESSLKRRLFRSMFLSTAATAPPSSSKPGPPPQSKPNSSFRPPQKDNPPSLVAKAQSLPSDQPVGTFSPLTTSDTSSPQKSLRTAPATGQLPGRSSPAGSPRTWHAQISTSNLYLPQDPTVAKGALAGEDTGVVTHEQFKAALRMVVDQGDPRLLLDSYVKIGEGSTGIVCLAREKHSGRQVAVKMMDLRKQQRRELLFNEVVIMRDYQHFNVVEMYKSYLVGEELWVLMEFLQGGALTDIVSQVRLNEEQIATVCEAVLQALAYLHAQGVIHRDIKSDSILLTLDGRVKLSDFGFCAQISKDVPKRKSLVGTPYWMAPEVISRSLYATEVDIWSLGIMVIEMVDGEPPYFSDSPVQAMKRLRDSPPPKLKNSHKVSPVLRDFLERMLVRDPQERATAQELLDHPFLLQTGLPECLVPLIQLYRKQTSTC

SEQ ID NO: 60815 - protein, 636 aa, Homo sapiens
  Payload ID: 12169
  Gene Symbol: PAK6
  Gene Name: p21 protein (Cdc42/Rac)-activated kinase 6
  Uniprot ID: Q9NQU5
  ENSP ID: ENSP00000409465
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHWATDPDMYLQSPQSERTDPHGLYLSCNGGTPAGHKQMPWPEPQSPRVLPNGLAAKAQSLGPAEFQGASQRCLQLGACLQSSPPGASPPTGTNRHGMKAAKHGSEEARPQSCLVGSATGRPGGEGSPSPKTRESSLKRRLFRSMFLSTAATAPPSSSKPGPPPQSKPNSSFRPPQKDNPPSLVAKAQSLPSDQPVGTFSPLTTSDTSSPQKSLRTAPATGQLPGRSSPAGSPRTWHAQISTSNLYLPQDPTVAKGALAGEDTGVVTHEQFKAALRMVVDQGDPRLLLDSYVKIGEGSTGIVCLAREKHSGRQVAVKMMDLRKQQRRELLFNEVVIMRDYQHFNVVEMYKSYLVGEELWVLMEFLQGGALTDIVSQVRLNEEQIATVCEAVLQALAYLHAQGVIHRDIKSDSILLTLDGRVKLSDFGFCAQISKDVPKRKSLVGTPYWMAPEVISRSLYATEVSPVLRDFLERMLVRDPQERATAQELLDHPFLLQTGLPECLVPLIQLYRKQTSTC

SEQ ID NO: 60816 - protein, 681 aa, Homo sapiens; identical to SEQ ID NO: 60814
  Payload ID: 12169
  Gene Symbol: PAK6
  Gene Name: p21 protein (Cdc42/Rac)-activated kinase 6
  Uniprot ID: Q9NQU5
  ENSP ID: ENSP00000439597

SEQ ID NO: 60817 - protein, 74 aa, Homo sapiens
  Payload ID: 12169
  Gene Symbol: PAK6
  Gene Name: p21 protein (Cdc42/Rac)-activated kinase 6
  ENSP ID: ENSP00000452647
MPGPGTMFRKKKKKRPEISAPQNFQHRVHTSFDPKEGKFVGLPPQWQNILDTLRRPKPVVDPSRITRVQLQPMK

SEQ ID NO: 60818 - protein, 109 aa, Homo sapiens
  Payload ID: 12169
  Gene Symbol: PAK6
  Gene Name: p21 protein (Cdc42/Rac)-activated kinase 6
  ENSP ID: ENSP00000452686
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRR

SEQ ID NO: 60819 - protein, 112 aa, Homo sapiens
  Payload ID: 12169
  Gene Symbol: PAK6
  Gene Name: p21 protein (Cdc42/Rac)-activated kinase 6
  ENSP ID: ENSP00000452708
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQ

SEQ ID NO: 60820 - protein, 57 aa, Homo sapiens
  Payload ID: 12169
  Gene Symbol: PAK6
  Gene Name: p21 protein (Cdc42/Rac)-activated kinase 6
  ENSP ID: ENSP00000452737
MPGPGTMFRKKKKKRPEISAPQNFQHRVHTSFDPKEGKFVGLPPQWQNILDTLRRPK

SEQ ID NO: 60821 - protein, 20 aa, Homo sapiens
  Payload ID: 12169
  Gene Symbol: PAK6
  Gene Name: p21 protein (Cdc42/Rac)-activated kinase 6
  ENSP ID: ENSP00000453005
MPGPGTMFRKKKKKRPEISA

SEQ ID NO: 60822 - protein, 284 aa, Homo sapiens
  Payload ID: 12169
  Gene Symbol: PAK6
  Gene Name: p21 protein (Cdc42/Rac)-activated kinase 6
  ENSP ID: ENSP00000453021
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHWATDPDMYLQSPQSERTDPHGLYLSCNGGTPAGHKQMPWPEPQSPRVLPNGLAAKAQSLGPAEFQGASQRCLQLGACLQSSPPGASPPTGTNRHGMKAAKHGSEEARPQSCLVGSATGRPGGEGSPSPKTRESSLKRRLFRSMFLSTAATAPPSSSKPGPPPQ

SEQ ID NO: 60823 - protein, 71 aa, Homo sapiens
  Payload ID: 12169
  Gene Symbol: PAK6
  Gene Name: p21 protein (Cdc42/Rac)-activated kinase 6
  ENSP ID: ENSP00000453057
MPGPGTMFRKKKKKRPEISAPQNFQHRVHTSFDPKEGKFVGLPPQWQNILDTLRRPKPVVDPSRITRVQLQ

SEQ ID NO: 60824 - protein, 122 aa, Homo sapiens
  Payload ID: 12169
  Gene Symbol: PAK6
  Gene Name: p21 protein (Cdc42/Rac)-activated kinase 6
  ENSP ID: ENSP00000453407
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHW

SEQ ID NO: 60825 - protein, 104 aa, Homo sapiens
  Payload ID: 12169
  Gene Symbol: PAK6
  Gene Name: p21 protein (Cdc42/Rac)-activated kinase 6
  ENSP ID: ENSP00000453520
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRS

SEQ ID NO: 60826 - protein, 123 aa, Homo sapiens
  Payload ID: 12169
  Gene Symbol: PAK6
  Gene Name: p21 protein (Cdc42/Rac)-activated kinase 6
  ENSP ID: ENSP00000453721
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHWA

SEQ ID NO: 60827 - protein, 681 aa, Homo sapiens; identical to SEQ ID NO: 60814
  Payload ID: 12169
  Gene Symbol: PAK6
  Gene Name: p21 protein (Cdc42/Rac)-activated kinase 6
  Uniprot ID: Q9NQU5
  ENSP ID: ENSP00000453858

SEQ ID NO: 60828 - protein, 133 aa, Homo sapiens
  Payload ID: 12170
  Gene Symbol:
  Gene Name: p21 protein (Cdc42/Rac)-activated kinase 6 [Source:EntrezGene
  Acc:56924]
  ENSP ID: ENSP00000401153
MFLPSAAFGLYRSWKDKRSWLTVLLPTRPAEDWPSKVPGLPSPQRLRERPSAGEESRGRGGRRRKAPCSARKRRNALRSQRHRTSSTVSTPPSTPKKASLWASPHNGRTSWTHCGAPSPWWTLRESHGCSSSP

SEQ ID NO: 60829 - protein, 681 aa, Homo sapiens; identical to SEQ ID NO: 60814
  Payload ID: 12170
  Gene Symbol:
  Gene Name: p21 protein (Cdc42/Rac)-activated kinase 6 [Source:EntrezGene
  Acc:56924]
  ENSP ID: ENSP00000406873

SEQ ID NO: 60830 - protein, 160 aa, Homo sapiens
  Payload ID: 12170
  Gene Symbol:
  Gene Name: p21 protein (Cdc42/Rac)-activated kinase 6 [Source:EntrezGene
  Acc:56924]
  ENSP ID: ENSP00000456785
VFTLSGFRTVQILEGQKILANCSSPYQGVPLPGLETSTSLQWRTQDPAAQKEQPRPAEDWPSKVPGLPSPQRLRERPSAGEESRGRGGRRRKAPCSARKRRNALRSQRHRTSSTVSTPPSTPKKASLWASPHNGRTSWTHCGAPSPWWTLRESHGCSSSP

SEQ ID NO: 60831 - protein, 141 aa, Homo sapiens
  Payload ID: 12170
  Gene Symbol:
  Gene Name: p21 protein (Cdc42/Rac)-activated kinase 6 [Source:EntrezGene
  Acc:56924]
  ENSP ID: ENSP00000457109
  MOD_RES (1)..(1): Any amino acid
XKEHLQVFWDGSFWKLSQNISELKDGELWNKFFVRILNANDEATVSVLGELAAEMNGVFDTTFQSHLNKALWKGVPLPGLETSTSLQWRTQDPAAQKEQPRPAEDWPSKVPGLPSPQRLRERPSAGEESRGRGGRRRKTVE

SEQ ID NO: 60832 - protein, 719 aa, Homo sapiens
  Payload ID: 12171
  Gene Symbol: PAK7
  Gene Name: p21 protein (Cdc42/Rac)-activated kinase 7
  Uniprot ID: Q9P286
  ENSP ID: ENSP00000322957
MFGKKKKKIEISGPSNFEHRVHTGFDPQEQKFTGLPQQWHSLLADTANRPKPMVDPSCITPIQLAPMKTIVRGNKPCKETSINGLLEDFDNISVTRSNSLRKESPPTPDQGASSHGPGHAEENGFITFSQYSSESDTTADYTTEKYREKSLYGDDLDPYYRGSHAAKQNGHVMKMKHGEAYYSEVKPLKSDFARFSADYHSHLDSLSKPSEYSDLKWEYQRASSSSPLDYSFQFTPSRTAGTSGCSKESLAYSESEWGPSLDDYDRRPKSSYLNQTSPQPTMRQRSRSGSGLQEPMMPFGASAFKTHPQGHSYNSYTYPRLSEPTMCIPKVDYDRAQMVLSPPLSGSDTYPRGPAKLPQSQSKSGYSSSSHQYPSGYHKATLYHHPSLQSSSQYISTASYLSSLSLSSSTYPPPSWGSSSDQQPSRVSHEQFRAALQLVVSPGDPREYLANFIKIGEGSTGIVCIATEKHTGKQVAVKKMDLRKQQRRELLFNEVVIMRDYHHDNVVDMYSSYLVGDELWVVMEFLEGGALTDIVTHTRMNEEQIATVCLSVLRALSYLHNQGVIHRDIKSDSILLTSDGRIKLSDFGFCAQVSKEVPKRKSLVGTPYWMAPEVISRLPYGTEVDIWSLGIMVIEMIDGEPPYFNEPPLQAMRRIRDSLPPRVKDLHKVSSVLRGFLDLMLVREPSQRATAQELLGHPFLKLAGPPSCIVPLMRQYRHH

SEQ ID NO: 60833 - protein, 719 aa, Homo sapiens; identical to SEQ ID NO: 60832
  Payload ID: 12171
  Gene Symbol: PAK7
  Gene Name: p21 protein (Cdc42/Rac)-activated kinase 7
  Uniprot ID: Q9P286
  ENSP ID: ENSP00000367679

SEQ ID NO: 60834 - protein, 719 aa, Homo sapiens; identical to SEQ ID NO: 60832
  Payload ID: 12171
  Gene Symbol: PAK7
  Gene Name: p21 protein (Cdc42/Rac)-activated kinase 7
  Uniprot ID: Q9P286
  ENSP ID: ENSP00000367686

SEQ ID NO: 60835 - protein, 432 aa, Homo sapiens
  Payload ID: 12172
  Gene Symbol: P2RX5-TAX1BP3
  Gene Name: P2RX5-TAX1BP3 readthrough (NMD candidate)
  ENSP ID: ENSP00000455681
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRLRTPSASPLHQE

SEQ ID NO: 60836 - protein, 633 aa, Homo sapiens
  Payload ID: 12173
  Gene Symbol: POR
  Gene Name: P450 (cytochrome) oxidoreductase
  Uniprot ID: P16435
  ENSP ID: ENSP00000378355
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCG

SEQ ID NO: 60837 - protein, 166 aa, Homo sapiens
  Payload ID: 12173
  Gene Symbol: POR
  Gene Name: P450 (cytochrome) oxidoreductase
  Uniprot ID: P16435
  ENSP ID: ENSP00000389409
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDL

SEQ ID NO: 60838 - protein, 62 aa, Homo sapiens
  Payload ID: 12173
  Gene Symbol: POR
  Gene Name: P450 (cytochrome) oxidoreductase
  Uniprot ID: P16435
  ENSP ID: ENSP00000389719
MINMGDSHVDTSSTVSEAVAEEVSLFSMTDMILFSLIVGLLTYWFLFRKKKEEVPEFTKIQT

SEQ ID NO: 60839 - protein, 188 aa, Homo sapiens
  Payload ID: 12173
  Gene Symbol: POR
  Gene Name: P450 (cytochrome) oxidoreductase
  Uniprot ID: P16435
  ENSP ID: ENSP00000390540
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMG

SEQ ID NO: 60840 - protein, 725 aa, Homo sapiens
  Payload ID: 12173
  Gene Symbol: POR
  Gene Name: P450 (cytochrome) oxidoreductase
  ENSP ID: ENSP00000393527
  MOD_RES (1)..(1): Any amino acid
XTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVSHPETAMGSRWPAVPPWGLQIHVSERQPSRPPPCPQQPGQATCETLSSAPDPSTTRMSPPCPQPQSAPGGIGCWRLKVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGTPSSCPGMHGTWPGMCRTPSTTSWLSSGPWSTRRRWTTSRN

SEQ ID NO: 60841 - protein, 140 aa, Homo sapiens
  Payload ID: 12173
  Gene Symbol: POR
  Gene Name: P450 (cytochrome) oxidoreductase
  Uniprot ID: P16435
  ENSP ID: ENSP00000395813
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCM

SEQ ID NO: 60842 - protein, 172 aa, Homo sapiens
  Payload ID: 12173
  Gene Symbol: POR
  Gene Name: P450 (cytochrome) oxidoreductase
  Uniprot ID: P16435
  ENSP ID: ENSP00000399327
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFA

SEQ ID NO: 60843 - protein, 101 aa, Homo sapiens
  Payload ID: 12173
  Gene Symbol: POR
  Gene Name: P450 (cytochrome) oxidoreductase
  ENSP ID: ENSP00000399409
MINMGDSHVDTSSTVSEAVAEEVSLFSMTDMILFSLIVGLLTYWFLFRKKKEEVPEFTKIQTLTSSVRESSFVEKMKKTVSFLHVFTLLRKPRPRWACNQV

SEQ ID NO: 60844 - protein, 62 aa, Homo sapiens; identical to SEQ ID NO: 60838
  Payload ID: 12173
  Gene Symbol: POR
  Gene Name: P450 (cytochrome) oxidoreductase
  Uniprot ID: P16435
  ENSP ID: ENSP00000399556

SEQ ID NO: 60845 - protein, 108 aa, Homo sapiens
  Payload ID: 12173
  Gene Symbol: POR
  Gene Name: P450 (cytochrome) oxidoreductase
  ENSP ID: ENSP00000400964
MGCTYSSPPEEPALRRTSSVRESSFVEKMKKTGRNIIVFYGSQTGTAEEFANRLSKDAHRYGMRGMSADPEEYDLADLSSLPEIDNALVVFCMATYGEGDPTDNAQDF

SEQ ID NO: 60846 - protein, 54 aa, Homo sapiens
  Payload ID: 12173
  Gene Symbol: POR
  Gene Name: P450 (cytochrome) oxidoreductase
  ENSP ID: ENSP00000403494
MRLPGVNSKDLLCQREQLCGKDEENGEEHHRVLRLPDGDCRGVCQPPVQGRPPL

SEQ ID NO: 60847 - protein, 211 aa, Homo sapiens
  Payload ID: 12173
  Gene Symbol: POR
  Gene Name: P450 (cytochrome) oxidoreductase
  Uniprot ID: P16435
  ENSP ID: ENSP00000404731
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKCGQGVHGGDGPAEELREPEAPL

SEQ ID NO: 60848 - protein, 146 aa, Homo sapiens
  Payload ID: 12173
  Gene Symbol: POR
  Gene Name: P450 (cytochrome) oxidoreductase
  Uniprot ID: P16435
  ENSP ID: ENSP00000409238
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEG

SEQ ID NO: 60849 - protein, 39 aa, Homo sapiens
  Payload ID: 12173
  Gene Symbol: POR
  Gene Name: P450 (cytochrome) oxidoreductase
  ENSP ID: ENSP00000409881
MINMGDSHVDTSSTVSEAVAEEVSLFSMTDMILFSLIVG

SEQ ID NO: 60850 - protein, 418 aa, Homo sapiens
  Payload ID: 12173
  Gene Symbol: POR
  Gene Name: P450 (cytochrome) oxidoreductase
  ENSP ID: ENSP00000412490
MGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 60851 - protein, 189 aa, Homo sapiens
  Payload ID: 12173
  Gene Symbol: POR
  Gene Name: P450 (cytochrome) oxidoreductase
  Uniprot ID: P16435
  ENSP ID: ENSP00000414263
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFALGGGLHHLARAVLAGRV

SEQ ID NO: 60852 - protein, 680 aa, Homo sapiens
  Payload ID: 12173
  Gene Symbol: POR
  Gene Name: P450 (cytochrome) oxidoreductase
  Uniprot ID: P16435
  ENSP ID: ENSP00000419970
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 60853 - protein, 133 aa, Homo sapiens
  Payload ID: 12174
  Gene Symbol: PDRG1
  Gene Name: p53 and DNA-damage regulated 1
  Uniprot ID: Q9NUG6
  ENSP ID: ENSP00000202017
MLSPEAERVLRYLVEVEELAEEVLADKRQIVDLDTKRNQNREGLRALQKDLSLSEDVMVCFGNMFIKMPHPETKEMIEKDQDHLDKEIEKLRKQLKVKVNRLFEAQGKPELKGFNLNPLNQDELKALKVILKG

SEQ ID NO: 60854 - protein, 910 aa, Homo sapiens
  Payload ID: 12175
  Gene Symbol: PIDD1
  Gene Name: p53-induced death domain protein 1
  Uniprot ID: Q9HB75
  ENSP ID: ENSP00000337797
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLAGLRSLRLLVLHSNLLASVPADLARLPLLTRLDLRDNQLRDLPPELLDAPFVRLQGNPLGEASPDAPSSPVAALIPEMPRLFLTSDLDSFPVTPQGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVTHFSWYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVYVTTTLDREAQAVRGQVSFYRGAVPVRVPEEAEAARQRKGADALWMATLPIKLPRLRGSEGPRRGAGLSLAPLNLGDAETGFLTQSNLLSVAGRLGLDWPAVALHLGVSYREVQRIRHEFRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 60855 - protein, 893 aa, Homo sapiens
  Payload ID: 12175
  Gene Symbol: PIDD1
  Gene Name: p53-induced death domain protein 1
  Uniprot ID: Q9HB75
  ENSP ID: ENSP00000416801
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLAGLRSLRLLVLHSNLLASVPADLARLPLLTRLDLRDNQLRDLPPELLDAPFVRLQGNPLGEASPDAPSSPVAALIPEMPRLFLTSDLDSFPVTPQGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVTHFSWYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVSFYRGAVPVRVPEEAEAARQRKGADALWMATLPIKLPRLRGSEGPRRGAGLSLAPLNLGDAETGFLTQSNLLSVAGRLGLDWPAVALHLGVSYREVQRIRHEFRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 60856 - protein, 338 aa, Homo sapiens
  Payload ID: 12175
  Gene Symbol: PIDD1
  Gene Name: p53-induced death domain protein 1
  ENSP ID: ENSP00000435008
  MOD_RES (1)..(1): Any amino acid
XAPFVRLQGNPLGEASPDAPSSPVAALIPEMPRLFLTSDLDSFPVTPQGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVLALVHHQELCGRPGSEGLGAAAAAPCEPHRSAAAPGP

SEQ ID NO: 60857 - protein, 108 aa, Homo sapiens
  Payload ID: 12175
  Gene Symbol: PIDD1
  Gene Name: p53-induced death domain protein 1
  ENSP ID: ENSP00000436146
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGSIWDLGPWL

SEQ ID NO: 60858 - protein, 108 aa, Homo sapiens; identical to SEQ ID NO: 60857
  Payload ID: 12175
  Gene Symbol: PIDD1
  Gene Name: p53-induced death domain protein 1
  ENSP ID: ENSP00000436342

SEQ ID NO: 60859 - protein, 531 aa, Homo sapiens
  Payload ID: 12176
  Gene Symbol: PAF1
  Gene Name: PAF1 homolog, Paf1/RNA polymerase II complex component
  Uniprot ID: Q8N7H5
  ENSP ID: ENSP00000221265
MAPTIQTQAQREDGHRPNSHRTLPERSGVVCRVKYCNSLPDIPFDPKFITYPFDQNRFVQYKATSLEKQHKHDLLTEPDLGVTIDLINPDTYRIDPNVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSDEEQEKGSSSEKEGSEDEHSGSESEREEGDRDEASDKSGSGEDESSEDEARAARDKEEIFGSDADSEDDADSDDEDRGQAQGGSDNDSDSGSNGGGQRSRSHSRSASPFPSGSEHSAQEDGSEAAASDSSEADSDSD

SEQ ID NO: 60860 - protein, 288 aa, Homo sapiens
  Payload ID: 12176
  Gene Symbol: PAF1
  Gene Name: PAF1 homolog, Paf1/RNA polymerase II complex component
  ENSP ID: ENSP00000396412
MATGPIPTGLCLRGLEWSAESSTAIASLISPSTPSSSPTPSTRTVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETSIQYSHMLYNLVA

SEQ ID NO: 60861 - protein, 485 aa, Homo sapiens
  Payload ID: 12176
  Gene Symbol: PAF1
  Gene Name: PAF1 homolog, Paf1/RNA polymerase II complex component
  Uniprot ID: Q8N7H5
  ENSP ID: ENSP00000468874
MAPTIQTQAQREDGHRSGVVCRVKYCNSLPDIPFDPKFITYPFDQNRFVQYKATSLEKQHKHDLLTEPDLGVTIDLINPDTYRIDPNVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSVMLILRTMPTLMMRTEDRPKVAVTMIQTAAAMGVASGAGATAAAPVPSPVAASTRPRRMAVKLQLLIPVKLIVTVTESQGIQGWFRHHYCEQQSTFLVVCL

SEQ ID NO: 60862 - protein, 94 aa, Homo sapiens
  Payload ID: 12176
  Gene Symbol: PAF1
  Gene Name: PAF1 homolog, Paf1/RNA polymerase II complex component
  ENSP ID: ENSP00000469742
  MOD_RES (1)..(1): Any amino acid
XVQSGTNALLVVKHRDMNEKELEAQEARKAQLENHEPEEEEEEEMETEEKEAGGSGKSGQARLWEPWEGGKVGFISLHSLPDEEQEKGSSSEKE

SEQ ID NO: 60863 - protein, 534 aa, Homo sapiens
  Payload ID: 12177
  Gene Symbol: PAX1
  Gene Name: paired box 1
  Uniprot ID: P15863
  ENSP ID: ENSP00000381499
MKFTLGLGSRAWRVSWEGAAAAAAGPGAGGSALRCRAQRVSSPRLGRRGSRLSGALPLCLSRGGGGAQALPDCAGPSPGHPGHPGARQLAGPLAMEQTYGEVNQLGGVFVNGRPLPNAIRLRIVELAQLGIRPCDISRQLRVSHGCVSKILARYNETGSILPGAIGGSKPRVTTPNVVKHIRDYKQGDPGIFAWEIRDRLLADGVCDKYNVPSVSSISRILRNKIGSLAQPGPYEASKQPPSQPTLPYNHIYQYPYPSPVSPTGAKMGSHPGVPGTAGHVSIPRSWPSAHSVSNILGIRTFMEQTGALAGSEGTAYSPKMEDWAGVNRTAFPATPAVNGLEKPALEADIKYTQSASTLSAVGGFLPACAYPASNQHGVYSAPGGGYLAPGPPWPPAQGPPLAPPGAGVAVHGGELAAAMTFKHPSREGSLPAPAARPRTPSVAYTDCPSRPRPPRGSSPRTRARRERQADPGAQVCAAAPAIGTGRIGGLAEEEASAGPRGARPASPQAQPCLWPDPPHFLYWSGFLGFSELGF

SEQ ID NO: 60864 - protein, 433 aa, Homo sapiens
  Payload ID: 12177
  Gene Symbol: PAX1
  Gene Name: paired box 1
  Uniprot ID: P15863
  ENSP ID: ENSP00000410355
MRRAPLRGSSAPLPTPSQTQAVCPWTPSCLGTHRSPLEVRLGAVPRSAWGPLANPPGVFSPSGSLLSGASAEQTYGEVNQLGGVFVNGRPLPNAIRLRIVELAQLGIRPCDISRQLRVSHGCVSKILARYNETGSILPGAIGGSKPRVTTPNVVKHIRDYKQGDPGIFAWEIRDRLLADGVCDKYNVPSVSSISRILRNKIGSLAQPGPYEASKQPPSQPTLPYNHIYQYPYPSPVSPTGAKMGSHPGVPGTAGHVSIPRSWPSAHSVSNILGIRTFMEQTGALAGSEGTAYSPKMEDWAGVNRTAFPATPAVNGLEKPALEADIKYTQSASTLSAVGGFLPACAYPASNQHGVYSAPGGGYLAPGPPWPPAQGPPLAPPGAGVAVHGGELAAAMTFKHPSREVADRKPPSSGSKAPDALSSLHGLPIPASTS

SEQ ID NO: 60865 - protein, 457 aa, Homo sapiens
  Payload ID: 12177
  Gene Symbol: PAX1
  Gene Name: paired box 1
  ENSP ID: ENSP00000481334
MKFTLGLGSRAWRVSWEGAAAAAAGPGAGGSALRCRAQRVSSPRLGRRGSRLSGALPLCLSRGGGGAQALPDCAGPSPGHPGHPGARQLAGPLAMEQTYGEVNQLGGVFVNGRPLPNAIRLRIVELAQLGIRPCDISRQLRVSHGCVSKILARYNETGSILPGAIGGSKPRVTTPNVVKHIRDYKQGDPGIFAWEIRDRLLADGVCDKYNVPSVSSISRILRNKIGSLAQPGPYEASKQPPSQPTLPYNHIYQYPYPSPVSPTGAKMGSHPGVPGTAGHVSIPRSWPSAHSVSNILGIRTFMEQTGALAGSEGTAYSPKMEDWAGVNRTAFPATPAVNGLEKPALEADIKYTQSASTLSAVGGFLPACAYPASNQHGVYSAPGGGYLAPGPPWPPAQGPPLAPPGAGVAVHGGELAAAMTFKHPSREVADRKPPSSGSKAPDALSSLHGLPIPASTS

SEQ ID NO: 60866 - protein, 394 aa, Homo sapiens
  Payload ID: 12178
  Gene Symbol: PAX2
  Gene Name: paired box 2
  Uniprot ID: Q02962
  ENSP ID: ENSP00000347385
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSAPAAAAAAYDRH

SEQ ID NO: 60867 - protein, 393 aa, Homo sapiens
  Payload ID: 12178
  Gene Symbol: PAX2
  Gene Name: paired box 2
  ENSP ID: ENSP00000355069
MDMHCKADPFSAMHRHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSAPAAAAAAYDRH

SEQ ID NO: 60868 - protein, 396 aa, Homo sapiens
  Payload ID: 12178
  Gene Symbol: PAX2
  Gene Name: paired box 2
  Uniprot ID: Q02962
  ENSP ID: ENSP00000359319
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPEAAVGPSSSLMSKPGRKLAEVPPCVQPTGASSPATRTATPSTRPTTRLGDSATPPY

SEQ ID NO: 60869 - protein, 417 aa, Homo sapiens
  Payload ID: 12178
  Gene Symbol: PAX2
  Gene Name: paired box 2
  Uniprot ID: Q02962
  ENSP ID: ENSP00000396259
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAHIRGGGGLHLVWTLRDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSAPAAAAAAYDRH

SEQ ID NO: 60870 - protein, 214 aa, Homo sapiens
  Payload ID: 12178
  Gene Symbol: PAX2
  Gene Name: paired box 2
  ENSP ID: ENSP00000398652
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAH

SEQ ID NO: 60871 - protein, 304 aa, Homo sapiens
  Payload ID: 12178
  Gene Symbol: PAX2
  Gene Name: paired box 2
  ENSP ID: ENSP00000452489
MAGPCCVWGVVFFSCLSPAGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGR

SEQ ID NO: 60872 - protein, 206 aa, Homo sapiens
  Payload ID: 12179
  Gene Symbol: PAX3
  Gene Name: paired box 3
  Uniprot ID: P23760
  ENSP ID: ENSP00000258387
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERGKALVSGVSSH

SEQ ID NO: 60873 - protein, 407 aa, Homo sapiens
  Payload ID: 12179
  Gene Symbol: PAX3
  Gene Name: paired box 3
  Uniprot ID: P23760
  ENSP ID: ENSP00000338767
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVPFIISSQISLGFKSF

SEQ ID NO: 60874 - protein, 403 aa, Homo sapiens
  Payload ID: 12179
  Gene Symbol: PAX3
  Gene Name: paired box 3
  Uniprot ID: P23760
  ENSP ID: ENSP00000342092
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVPFIISSQISRK

SEQ ID NO: 60875 - protein, 479 aa, Homo sapiens
  Payload ID: 12179
  Gene Symbol: PAX3
  Gene Name: paired box 3
  Uniprot ID: P23760
  ENSP ID: ENSP00000343052
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSKPWTF

SEQ ID NO: 60876 - protein, 505 aa, Homo sapiens
  Payload ID: 12179
  Gene Symbol: PAX3
  Gene Name: paired box 3
  Uniprot ID: P23760
  ENSP ID: ENSP00000375921
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIAWFQILLNTFDKSSGEEEDLEQ

SEQ ID NO: 60877 - protein, 484 aa, Homo sapiens
  Payload ID: 12179
  Gene Symbol: PAX3
  Gene Name: paired box 3
  Uniprot ID: P23760
  ENSP ID: ENSP00000375922
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIA

SEQ ID NO: 60878 - protein, 483 aa, Homo sapiens
  Payload ID: 12179
  Gene Symbol: PAX3
  Gene Name: paired box 3
  Uniprot ID: P23760
  ENSP ID: ENSP00000386750
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIA

SEQ ID NO: 60879 - protein, 215 aa, Homo sapiens
  Payload ID: 12179
  Gene Symbol: PAX3
  Gene Name: paired box 3
  Uniprot ID: P23760
  ENSP ID: ENSP00000386817
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERGKRWRLGRRTCWVTWRASAS

SEQ ID NO: 60880 - protein, 343 aa, Homo sapiens
  Payload ID: 12180
  Gene Symbol: PAX4
  Gene Name: paired box 4
  Uniprot ID: O43316
  ENSP ID: ENSP00000339906
MNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWGHLPPQPNSLDSGLLCLPCPSSHCHLASLSGSQALLWPGCPLLYGLE

SEQ ID NO: 60881 - protein, 349 aa, Homo sapiens
  Payload ID: 12180
  Gene Symbol: PAX4
  Gene Name: paired box 4
  ENSP ID: ENSP00000344297
MHQDGISSMNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWDCGSFLLPVIAPSCVDVAWPCLDASLAHHLIGGAGKATPTHFSHP

SEQ ID NO: 60882 - protein, 340 aa, Homo sapiens
  Payload ID: 12180
  Gene Symbol: PAX4
  Gene Name: paired box 4
  ENSP ID: ENSP00000368014
MNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWDCGSFLLPVIAPSCVDVAWPCLDASLAHHLIGGAGKATPTHFSH

SEQ ID NO: 60883 - protein, 341 aa, Homo sapiens
  Payload ID: 12180
  Gene Symbol: PAX4
  Gene Name: paired box 4
  ENSP ID: ENSP00000451923
MAWSSKSWLCLIASSCPRDTLLPSAHHASPVPASHLTQVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWGHLPPQPNSLDSGLLCLPCPSSHCHLASLSGSQALLWPGCPLLYGLE

SEQ ID NO: 60884 - protein, 257 aa, Homo sapiens
  Payload ID: 12180
  Gene Symbol: PAX4
  Gene Name: paired box 4
  ENSP ID: ENSP00000473846
MAWSSKSWLCLIASSCPRDTLLPSAHHASPVPASHLTQVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQGPTVFMSRKY

SEQ ID NO: 60885 - protein, 257 aa, Homo sapiens; identical to SEQ ID NO: 60884
  Payload ID: 12180
  Gene Symbol: PAX4
  Gene Name: paired box 4
  ENSP ID: ENSP00000477877

SEQ ID NO: 60886 - protein, 391 aa, Homo sapiens
  Payload ID: 12181
  Gene Symbol: PAX5
  Gene Name: paired box 5
  Uniprot ID: Q02548
  ENSP ID: ENSP00000350844
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 60887 - protein, 288 aa, Homo sapiens
  Payload ID: 12181
  Gene Symbol: PAX5
  Gene Name: paired box 5
  Uniprot ID: Q02548
  ENSP ID: ENSP00000367071
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQAVTWRARPSPGTLHTSPPLDRAATQHRR

SEQ ID NO: 60888 - protein, 328 aa, Homo sapiens
  Payload ID: 12181
  Gene Symbol: PAX5
  Gene Name: paired box 5
  Uniprot ID: Q02548
  ENSP ID: ENSP00000367078
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGSPYYYSAAARGAAPPAAATAYDRH

SEQ ID NO: 60889 - protein, 357 aa, Homo sapiens
  Payload ID: 12181
  Gene Symbol: PAX5
  Gene Name: paired box 5
  Uniprot ID: Q02548
  ENSP ID: ENSP00000367083
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGSEFSGSPYSHPQYSSYNDSWRFPNPGLLGSPYYYSAAARGAAPPAAATAYDRH

SEQ ID NO: 60890 - protein, 362 aa, Homo sapiens
  Payload ID: 12181
  Gene Symbol: PAX5
  Gene Name: paired box 5
  Uniprot ID: Q02548
  ENSP ID: ENSP00000367084
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSPYYYSAAARGAAPPAAATAYDRH

SEQ ID NO: 60891 - protein, 291 aa, Homo sapiens
  Payload ID: 12181
  Gene Symbol: PAX5
  Gene Name: paired box 5
  Uniprot ID: Q02548
  ENSP ID: ENSP00000404687
MDLEKNYPTPRTSRTGHGGVNQLGGVFVNGRPLPDVVRQRIVELAHQGVRPCDISRQLRVSHGCVSKILGRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGSEFSGSPYSHPQYSSYNDSWRFPNPGLLGSPYYYSAAARGAAPPAAATAYDRH

SEQ ID NO: 60892 - protein, 348 aa, Homo sapiens
  Payload ID: 12181
  Gene Symbol: PAX5
  Gene Name: paired box 5
  Uniprot ID: Q02548
  ENSP ID: ENSP00000412188
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 60893 - protein, 60 aa, Homo sapiens
  Payload ID: 12181
  Gene Symbol: PAX5
  Gene Name: paired box 5
  ENSP ID: ENSP00000428670
  MOD_RES (1)..(1): Any amino acid
XSSVSTDSAGSSYSISGILGITSPSADTNKRKRDEGSPYYYSAAARGAAPPAAATAYDRH

SEQ ID NO: 60894 - protein, 220 aa, Homo sapiens
  Payload ID: 12181
  Gene Symbol: PAX5
  Gene Name: paired box 5
  ENSP ID: ENSP00000429197
MFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGSPYYYSAAARGAAPPAAATAYDRH

SEQ ID NO: 60895 - protein, 295 aa, Homo sapiens
  Payload ID: 12181
  Gene Symbol: PAX5
  Gene Name: paired box 5
  ENSP ID: ENSP00000429291
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQAPPTIIALPPEEPPHLQPPLPMTVTDPWSQAGTKH

SEQ ID NO: 60896 - protein, 283 aa, Homo sapiens
  Payload ID: 12181
  Gene Symbol: PAX5
  Gene Name: paired box 5
  ENSP ID: ENSP00000429359
MFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 60897 - protein, 218 aa, Homo sapiens
  Payload ID: 12181
  Gene Symbol: PAX5
  Gene Name: paired box 5
  ENSP ID: ENSP00000429404
DTNKRKRDEGIQESPVPNGHSLPGRDFLRKQMRGDLFTQQQLEVLDRVFERQHYSDIFTTTEPIKPEQWCPVLMRQYLVQPQAVLFQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 60898 - protein, 324 aa, Homo sapiens
  Payload ID: 12181
  Gene Symbol: PAX5
  Gene Name: paired box 5
  ENSP ID: ENSP00000429637
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQGVSFPGVPTATLSIPRTTTPGGSPTRGCLAPPTIIALPPEEPPHLQPPLPMTVTDPWSQAGTKH

SEQ ID NO: 60899 - protein, 319 aa, Homo sapiens
  Payload ID: 12181
  Gene Symbol: PAX5
  Gene Name: paired box 5
  Uniprot ID: Q02548
  ENSP ID: ENSP00000430773
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSPYYYSAAARGAAPPAAATAYDRH

SEQ ID NO: 60900 - protein, 307 aa, Homo sapiens
  Payload ID: 12181
  Gene Symbol: PAX5
  Gene Name: paired box 5
  Uniprot ID: Q02548
  ENSP ID: ENSP00000431038
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQWCPVLMRQYLVQPQAVLFQAVTWRARPSPGTLHTSPPLDRAATQHRR

SEQ ID NO: 60901 - protein, 422 aa, Homo sapiens [sequence omitted]

SEQ ID NO: 60902 - protein, 436 aa, Homo sapiens
  Payload ID: 12182
  Gene Symbol: PAX6
  Gene Name: paired box 6
  Uniprot ID: P26367
  ENSP ID: ENSP00000368401
MQNSHSGVNQLGGVFVNGRPLPDSTRQKIVELAHSGARPCDISRILQTHADAKVQVLDNQNVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 60903 - protein, 422 aa, Homo sapiens [sequence omitted]

SEQ ID NO: 60904 - protein, 422 aa, Homo sapiens [sequence omitted]

SEQ ID NO: 60905 - protein, 436 aa, Homo sapiens; identical to SEQ ID NO: 60902
  Payload ID: 12182
  Gene Symbol: PAX6
  Gene Name: paired box 6
  Uniprot ID: P26367
  ENSP ID: ENSP00000368410

SEQ ID NO: 60906 - protein, 422 aa, Homo sapiens [sequence omitted]

SEQ ID NO: 60907 - protein, 436 aa, Homo sapiens; identical to SEQ ID NO: 60902
  Payload ID: 12182
  Gene Symbol: PAX6
  Gene Name: paired box 6
  Uniprot ID: P26367
  ENSP ID: ENSP00000368424

SEQ ID NO: 60908 - protein, 422 aa, Homo sapiens [sequence omitted]

SEQ ID NO: 60909 - protein, 61 aa, Homo sapiens
  Payload ID: 12182
  Gene Symbol: PAX6
  Gene Name: paired box 6
  ENSP ID: ENSP00000388132
MQNSHSGVNQLGGVFVNGRPLPDSTRQKIVELAHSGARPCDISRILQTHADAKVQVLDNQN

SEQ ID NO: 60910 - protein, 124 aa, Homo sapiens
  Payload ID: 12182
  Gene Symbol: PAX6
  Gene Name: paired box 6
  ENSP ID: ENSP00000397384
MQNSHSGVNQLGGVFVNGRPLPDSTRQKIVELAHSGARPCDISRILQTHADAKVQVLDNQNVSNGCVSSINRVLRNLASEKQQMGADGMYDKLRMLNGQTGSWGTRPGWYPGTSVPGQPTQDGC

SEQ ID NO: 60911 - protein, 436 aa, Homo sapiens; identical to SEQ ID NO: 60902
  Payload ID: 12182
  Gene Symbol: PAX6
  Gene Name: paired box 6
  Uniprot ID: P26367
  ENSP ID: ENSP00000404100

SEQ ID NO: 60912 - protein, 38 aa, Homo sapiens
  Payload ID: 12182
  Gene Symbol: PAX6
  Gene Name: paired box 6
  ENSP ID: ENSP00000404356
MQNSHSGVNQLGGVFVNGRPLPDSTRQKIVELAHSGAR

SEQ ID NO: 60913 - protein, 57 aa, Homo sapiens
  Payload ID: 12182
  Gene Symbol: PAX6
  Gene Name: paired box 6
  ENSP ID: ENSP00000431585
MQNSHSGVNQLGGVFVNGRPLPDSTRQKIVELAHSGARPCDISRILQVSNGCVSKIL

SEQ ID NO: 60914 - protein, 2 aa, Homo sapiens
  Payload ID: 12182
  Gene Symbol: PAX6
  Gene Name: paired box 6
  ENSP ID: ENSP00000436365
MQ

SEQ ID NO: 60915 - protein, 436 aa, Homo sapiens; identical to SEQ ID NO: 60902
  Payload ID: 12182
  Gene Symbol: PAX6
  Gene Name: paired box 6
  Uniprot ID: P26367
  ENSP ID: ENSP00000480026

SEQ ID NO: 60916 - protein, 520 aa, Homo sapiens
  Payload ID: 12183
  Gene Symbol: PAX7
  Gene Name: paired box 7
  Uniprot ID: P23759
  ENSP ID: ENSP00000364524
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSGLVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQSECLVPWASPVPIPSPTPRASCLFMESYKVVSGWGMSISQMEKLKSSQMEQFT

SEQ ID NO: 60917 - protein, 518 aa, Homo sapiens
  Payload ID: 12183
  Gene Symbol: PAX7
  Gene Name: paired box 7
  Uniprot ID: P23759
  ENSP ID: ENSP00000383502
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQSECLVPWASPVPIPSPTPRASCLFMESYKVVSGWGMSISQMEKLKSSQMEQFT

SEQ ID NO: 60918 - protein, 505 aa, Homo sapiens
  Payload ID: 12183
  Gene Symbol: PAX7
  Gene Name: paired box 7
  Uniprot ID: P23759
  ENSP ID: ENSP00000403389
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSGLVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQTAVDYLAKNVSLSTQRRMKLGEHSAVLGLLPVETGQAY

SEQ ID NO: 60919 - protein, 450 aa, Homo sapiens
  Payload ID: 12184
  Gene Symbol: PAX8
  Gene Name: paired box 8
  Uniprot ID: Q06710
  ENSP ID: ENSP00000263334
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVADPHSPFAIKQETPEVSSSSSTPSSLSSSAFLDLQQVGSGVPPFNAFPHAASVYGQFTGQALLSGREMVGPTLPGYPPHIPTSGQGSYASSAIAGMVAGSEYSGNAYGHTPYSSYSEAWRFPNSSLLSSPYYYSSTSRPSAPPTTATAFDHL

SEQ ID NO: 60920 - protein, 321 aa, Homo sapiens
  Payload ID: 12184
  Gene Symbol: PAX8
  Gene Name: paired box 8
  Uniprot ID: Q06710
  ENSP ID: ENSP00000263335
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGERWWGPRCPDTHPTSPPADRAAMPPLPSQAWWQEVNTLAMPMATPPTPPTARPGASPTPAC

SEQ ID NO: 60921 - protein, 398 aa, Homo sapiens
  Payload ID: 12184
  Gene Symbol: PAX8
  Gene Name: paired box 8
  Uniprot ID: Q06710
  ENSP ID: ENSP00000314750
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVAAPPFWICSKSAPGSRPSMPFPMLPPCTGSSRARPSSQGERWWGPRCPDTHPTSPPADRAAMPPLPSQAWWQEVNTLAMPMATPPTPPTARPGASPTPAC

SEQ ID NO: 60922 - protein, 287 aa, Homo sapiens
  Payload ID: 12184
  Gene Symbol: PAX8
  Gene Name: paired box 8
  Uniprot ID: Q06710
  ENSP ID: ENSP00000380768
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQEVNTLAMPMATPPTPPTARPGASPTPAC

SEQ ID NO: 60923 - protein, 450 aa, Homo sapiens; identical to SEQ ID NO: 60919
  Payload ID: 12184
  Gene Symbol: PAX8
  Gene Name: paired box 8
  Uniprot ID: Q06710
  ENSP ID: ENSP00000395498

SEQ ID NO: 60924 - protein, 116 aa, Homo sapiens
  Payload ID: 12184
  Gene Symbol: PAX8
  Gene Name: paired box 8
  ENSP ID: ENSP00000451213
MDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQ

SEQ ID NO: 60925 - protein, 173 aa, Homo sapiens
  Payload ID: 12184
  Gene Symbol: PAX8
  Gene Name: paired box 8
  ENSP ID: ENSP00000451240
  MOD_RES (1)..(1): Any amino acid
XSSGPRKHLRTDAFSQHHLEPLECPFERQHYPEAYASPSHTKGEQGLYPLPLLNSTLDDGKATLTPSNTPLGRNLSTHQTYPVVAGREMVGPTLPGYPPHIPTSGQGSYASSAIAGMVAGSEYSGNAYGHTPYSSYSEAWRFPNSSLLSSPYYYSSTSRPSAPPTTATAFDHL

SEQ ID NO: 60926 - protein, 85 aa, Homo sapiens
  Payload ID: 12184
  Gene Symbol: PAX8
  Gene Name: paired box 8
  ENSP ID: ENSP00000451618
MVGPTLPGYPPHIPTSGQGSYASSAIAGMVAGSEYSGNAYGHTPYSSYSEAWRFPNSSLLSSPYYYSSTSRPSAPPTTATAFDHL

SEQ ID NO: 60927 - protein, 98 aa, Homo sapiens
  Payload ID: 12184
  Gene Symbol: PAX8
  Gene Name: paired box 8
  ENSP ID: ENSP00000452547
  MOD_RES (1)..(1): Any amino acid
XHAASVYGQFTGQALLSGREMVGPTLPGYPPHIPTSGQGSYASSAIAGMVAGKERAGRKGSTAKRKYWSKEVNTLAMPMATPPTPPTARPGASPTPAC

SEQ ID NO: 60928 - protein, 341 aa, Homo sapiens
  Payload ID: 12185
  Gene Symbol: PAX9
  Gene Name: paired box 9
  Uniprot ID: P55771
  ENSP ID: ENSP00000355245
MEPAFGEVNQLGGVFVNGRPLPNAIRLRIVELAQLGIRPCDISRQLRVSHGCVSKILARYNETGSILPGAIGGSKPRVTTPTVVKHIRTYKQRDPGIFAWEIRDRLLADGVCDKYNVPSVSSISRILRNKIGNLAQQGHYDSYKQHQPTPQPALPYNHIYSYPSPITAAAAKVPTPPGVPAIPGSVAMPRTWPSSHSVTDILGIRSITDQVSDSSPYHSPKVEEWSSLGRNNFPAAAPHAVNGLEKGALEQEAKYGQAPNGLPAVGSFVSASSMAPYPTPAQVSPYMTYSAAPSGYVAGHGWQHAGGTSLSPHNCDIPASLAFKGMQAAREGSHSVTASAL

SEQ ID NO: 60929 - protein, 341 aa, Homo sapiens; identical to SEQ ID NO: 60928
  Payload ID: 12185
  Gene Symbol: PAX9
  Gene Name: paired box 9
  Uniprot ID: P55771
  ENSP ID: ENSP00000384817

SEQ ID NO: 60930 - protein, 96 aa, Homo sapiens
  Payload ID: 12185
  Gene Symbol: PAX9
  Gene Name: paired box 9
  ENSP ID: ENSP00000450434
MPRTWPSSHSVTDILGIRSITDQVSDSSPYHSPKVEEWSSLGRNNFPAAAPHAVNGLEKGALEQEAKHQMVSQLWAVLCQHPAWLLTLPQPKCRLT

SEQ ID NO: 60931 - protein, 303 aa, Homo sapiens
  Payload ID: 12186
  Gene Symbol: PILRA
  Gene Name: paired immunoglobin-like type 2 receptor alpha
  Uniprot ID: Q9UKJ1
  ENSP ID: ENSP00000198536
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPRAPPSHRPLKSPQNETLYSVLKA

SEQ ID NO: 60932 - protein, 230 aa, Homo sapiens
  Payload ID: 12186
  Gene Symbol: PILRA
  Gene Name: paired immunoglobin-like type 2 receptor alpha
  Uniprot ID: Q9UKJ1
  ENSP ID: ENSP00000340109
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGQQRTKATTPAREPFQNTEEPYENIRNEGQNTDPKLNPKDDGIVYASLALSSSTSPRAPPSHRPLKSPQNETLYSVLKA

SEQ ID NO: 60933 - protein, 175 aa, Homo sapiens
  Payload ID: 12186
  Gene Symbol: PILRA
  Gene Name: paired immunoglobin-like type 2 receptor alpha
  Uniprot ID: Q9UKJ1
  ENSP ID: ENSP00000377569
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGNPSKTQRSHMRISGMKDKIQIPS

SEQ ID NO: 60934 - protein, 226 aa, Homo sapiens
  Payload ID: 12186
  Gene Symbol: PILRA
  Gene Name: paired immunoglobin-like type 2 receptor alpha
  ENSP ID: ENSP00000390026
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGQQRTKATTPAREPFQNTEEPYENIRNEGQNTDPKLNPKLHLTQSTSQPPSPQEPPERDPVLCLKGLTNGQPSQD

SEQ ID NO: 60935 - protein, 166 aa, Homo sapiens
  Payload ID: 12186
  Gene Symbol: PILRA
  Gene Name: paired immunoglobin-like type 2 receptor alpha
  ENSP ID: ENSP00000415111
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGQQRTKATTPAREPF

SEQ ID NO: 60936 - protein, 127 aa, Homo sapiens
  Payload ID: 12187
  Gene Symbol: PILRB
  Gene Name: paired immunoglobin-like type 2 receptor beta
  ENSP ID: ENSP00000389856
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRV

SEQ ID NO: 60937 - protein, 227 aa, Homo sapiens
  Payload ID: 12187
  Gene Symbol: PILRB
  Gene Name: paired immunoglobin-like type 2 receptor beta
  Uniprot ID: Q9UKJ0
  ENSP ID: ENSP00000391748
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRVELDTRRSGRQQLQSIKGTKLTITQAVTTTTTWRPSSTTTIAGLRVTESKGHSESWHLSLDTAIRVALAVAVLKTVILGLLCLLLLWWRRRKGSRAPSSDF

SEQ ID NO: 60938 - protein, 107 aa, Homo sapiens
  Payload ID: 12187
  Gene Symbol: PILRB
  Gene Name: paired immunoglobin-like type 2 receptor beta
  ENSP ID: ENSP00000402073
MGRASYGGSPVGHQSSSDHPRAKTCRSPVRDGPRTLCGVPTVALSLHFLREASSGSRTCGRRTSLCTSAKSSWTYRSGRLSWQSIKGTHLTITQALRQPLHRAPLLP

SEQ ID NO: 60939 - protein, 127 aa, Homo sapiens; identical to SEQ ID NO: 60936
  Payload ID: 12187
  Gene Symbol: PILRB
  Gene Name: paired immunoglobin-like type 2 receptor beta
  ENSP ID: ENSP00000403757

SEQ ID NO: 60940 - protein, 127 aa, Homo sapiens; identical to SEQ ID NO: 60936
  Payload ID: 12187
  Gene Symbol: PILRB
  Gene Name: paired immunoglobin-like type 2 receptor beta
  ENSP ID: ENSP00000404321

SEQ ID NO: 60941 - protein, 121 aa, Homo sapiens
  Payload ID: 12187
  Gene Symbol: PILRB
  Gene Name: paired immunoglobin-like type 2 receptor beta
  ENSP ID: ENSP00000408425
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQS

SEQ ID NO: 60942 - protein, 46 aa, Homo sapiens
  Payload ID: 12187
  Gene Symbol: PILRB
  Gene Name: paired immunoglobin-like type 2 receptor beta
  ENSP ID: ENSP00000409411
MGRPLLLPLLLLLQPPAFLQPEGQESGFLRISNLRKEDQSVYFCRV

SEQ ID NO: 60943 - protein, 127 aa, Homo sapiens; identical to SEQ ID NO: 60936
  Payload ID: 12187
  Gene Symbol: PILRB
  Gene Name: paired immunoglobin-like type 2 receptor beta
  ENSP ID: ENSP00000411261

SEQ ID NO: 60944 - protein, 271 aa, Homo sapiens
  Payload ID: 12187
  Gene Symbol: PILRB
  Gene Name: paired immunoglobin-like type 2 receptor beta
  Uniprot ID: Q9UKJ0
  ENSP ID: ENSP00000415775
MGRASYGGSPVGHQSSSDHPRAKTCRSPVRDGPRTLCGVPTVALSLHFLREASSGSRTCGRRTSLCTSAKSSWTYRSGRLSWQSIKGTHLTITQALRQPLHRAPLLPGQLCWSPRPLEKNKAMGRPLLLPLLLLLQPPAFLQPGLCEPALSELDRGSGERLPQDLKPAEGGPVCVFLPSRAGHPEIREAAVAVHQGDQTHHHPGCHNHHHLEAQQHNHHSRPQGHRKQRALRIMAPKSGHCHQGCIGCRCAQNCHFGTAVPPPPVVEEKER

SEQ ID NO: 60945 - protein, 60 aa, Homo sapiens
  Payload ID: 12187
  Gene Symbol: PILRB
  Gene Name: paired immunoglobin-like type 2 receptor beta
  ENSP ID: ENSP00000416342
MGRPLLLPLLLLLQPPAFLQPGLCEPALSELDRGSGERLPQDLKPAEGGPVCVFLPSRAG

SEQ ID NO: 60946 - protein, 138 aa, Homo sapiens
  Payload ID: 12187
  Gene Symbol: PILRB
  Gene Name: paired immunoglobin-like type 2 receptor beta
  ENSP ID: ENSP00000476607
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRVELDTRRSGRQQ

SEQ ID NO: 60947 - protein, 227 aa, Homo sapiens; identical to SEQ ID NO: 60937
  Payload ID: 12187
  Gene Symbol: PILRB
  Gene Name: paired immunoglobin-like type 2 receptor beta
  Uniprot ID: Q9UKJ0
  ENSP ID: ENSP00000477365

SEQ ID NO: 60948 - protein, 245 aa, Homo sapiens
  Payload ID: 12188
  Gene Symbol: PRRX1
  Gene Name: paired related homeobox 1
  Uniprot ID: P54821
  ENSP ID: ENSP00000239461
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYSAMATYSATCANNSPAQGINMANSIANLRLKAKEYSLQRNQVPTVN

SEQ ID NO: 60949 - protein, 217 aa, Homo sapiens
  Payload ID: 12188
  Gene Symbol: PRRX1
  Gene Name: paired related homeobox 1
  Uniprot ID: P54821
  ENSP ID: ENSP00000356734
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYRSSSLPRCCLHEGLHNGF

SEQ ID NO: 60950 - protein, 200 aa, Homo sapiens
  Payload ID: 12188
  Gene Symbol: PRRX1
  Gene Name: paired related homeobox 1
  ENSP ID: ENSP00000450762
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYR

SEQ ID NO: 60951 - protein, 253 aa, Homo sapiens
  Payload ID: 12189
  Gene Symbol: PRRX2
  Gene Name: paired related homeobox 2
  Uniprot ID: Q99811
  ENSP ID: ENSP00000361547
MDSAAAAFALDKPALGPGPPPPPPALGPGDCAQARKNFSVSHLLDLEEVAAAGRLAARPGARAEAREGAAREPSGGSSGSEAAPQDGECPSPGRGSAAKRKKKQRRNRTTFNSSQLQALERVFERTHYPDAFVREELARRVNLSEARVQVWFQNRRAKFRRNERAMLASRSASLLKSYSQEAAIEQPVAPRPTALSPDYLSWTASSPYSTVPPYSPGSSGPATPGVNMANSIASLRLKAKEFSLHHSQVPTVN

SEQ ID NO: 60952 - protein, 284 aa, Homo sapiens
  Payload ID: 12190
  Gene Symbol: PHOX2A
  Gene Name: paired-like homeobox 2a
  Uniprot ID: O14813
  ENSP ID: ENSP00000298231
MDYSYLNSYDSCVAAMEASAYGDFGACSQPGGFQYSPLRPAFPAAGPPCPALGSSNCALGALRDHQPAPYSAVPYKFFPEPSGLHEKRKQRRIRTTFTSAQLKELERVFAETHYPDIYTREELALKIDLTEARVQVWFQNRRAKFRKQERAASAKGAAGAAGAKKGEARCSSEDDDSKESTCSPTPDSTASLPPPPAPGLASPRLSPSPLPVALGSGPGPGPGPQPLKGALWAGVAGGGGGGPGAGAAELLKAWQPAESGPGPFSGVLSSFHRKPGPALKTNLF

SEQ ID NO: 60953 - protein, 85 aa, Homo sapiens
  Payload ID: 12190
  Gene Symbol: PHOX2A
  Gene Name: paired-like homeobox 2a
  ENSP ID: ENSP00000444845
  MOD_RES (1)..(1): Any amino acid
XERVFAETHYPDIYTREELALKIDLTEARGALWAGVAGGGGGGPGAGAAELLKAWQPAESGPGPFSGVLSSFHRKPGPALKTNLF

SEQ ID NO: 60954 - protein, 314 aa, Homo sapiens
  Payload ID: 12191
  Gene Symbol: PHOX2B
  Gene Name: paired-like homeobox 2b
  Uniprot ID: Q99453
  ENSP ID: ENSP00000226382
MYKMEYSYLNSSAYESCMAGMDTSSLASAYADFSSCSQASGFQYNPIRTTFGATSGCPSLTPGSCSLGTLRDHQSSPYAAVPYKLFTDHGGLNEKRKQRRIRTTFTSAQLKELERVFAETHYPDIYTREELALKIDLTEARVQVWFQNRRAKFRKQERAAAAAAAAAKNGSSGKKSDSSRDDESKEAKSTDPDSTGGPGPNPNPTPSCGANGGGGGGPSPAGAPGAAGPGGPGGEPGKGGAAAAAAAAAAAAAAAAAAAAGGLAAAGGPGQGWAPGPGPITSIPDSLGGPFASVLSSLQRPNGAKAALVKSSMF

SEQ ID NO: 60955 - protein, 314 aa, Homo sapiens
  Payload ID: 12192
  Gene Symbol: PITX1
  Gene Name: paired-like homeodomain 1
  Uniprot ID: P78337
  ENSP ID: ENSP00000265340
MDAFKGGMSLERLPEGLRPPPPPPHDMGPAFHLARPADPREPLENSASESSDTELPEKERGGEPKGPEDSGAGGTGCGGADDPAKKKKQRRQRTHFTSQQLQELEATFQRNRYPDMSMREEIAVWTNLTEPRVRVWFKNRRAKWRKRERNQQLDLCKGGYVPQFSGLVQPYEDVYAAGYSYNNWAAKSLAPAPLSTKSFTFFNSMSPLSSQSMFSAPSSISSMTMPSSMGPGAVPGMPNSGLNNINNLTGSSLNSAMSPGACPYGTPASPYSVYRDTCNSSLASLRLKSKQHSSFGYGGLQGPASGLNACQYNS

SEQ ID NO: 60956 - protein, 130 aa, Homo sapiens
  Payload ID: 12192
  Gene Symbol: PITX1
  Gene Name: paired-like homeodomain 1
  ENSP ID: ENSP00000422908
MDAFKGGMSLERLPEGLRPPPPPPHDMGPAFHLARPADPREPLENSASESSDTELPEKERGGEPKGPEDSGAGGTGCGGADDPAKKKKQRRQRTHFTSQQLQELEATFQRNRYPDMSMREEIAVWTNLTE

SEQ ID NO: 60957 - protein, 114 aa, Homo sapiens
  Payload ID: 12192
  Gene Symbol: PITX1
  Gene Name: paired-like homeodomain 1
  ENSP ID: ENSP00000423624
MDAFKGGMSLERLPEGLRPPPPPPHDMGPAFHLARPADPREPLENSASESSDTELPEKERGGEPKGPEDSGAGGTGCGGADDPAKKKKQRRQRTHFTSQQLQELEATFQRNRYP

SEQ ID NO: 60958 - protein, 314 aa, Homo sapiens; identical to SEQ ID NO: 60955
  Payload ID: 12192
  Gene Symbol: PITX1
  Gene Name: paired-like homeodomain 1
  Uniprot ID: P78337
  ENSP ID: ENSP00000427542

SEQ ID NO: 60959 - protein, 208 aa, Homo sapiens
  Payload ID: 12192
  Gene Symbol: PITX1
  Gene Name: paired-like homeodomain 1
  ENSP ID: ENSP00000451199
  MOD_RES (1)..(1): Any amino acid
XRSRDPAHVRGRSPEQPGSGPRPGSCASPSALPFFVRAGAFFQQRTGPAGGRRGQWGSESAAQRSRPGSGGAPSSPVWAPLLRSFLNTQLNVSLHFLKKERGGEPKGPEDSGAGGTGCGGADDPAKKKKQRRQRTHFTSQQLQELEATFQRNRYPDMSMREEIAVWTNLTEPRVRVWFKNRRAKWRKRERNQQLDLCKGGYVPQFSGL

SEQ ID NO: 60960 - protein, 324 aa, Homo sapiens
  Payload ID: 12193
  Gene Symbol: PITX2
  Gene Name: paired-like homeodomain 2
  Uniprot ID: Q99697
  ENSP ID: ENSP00000304169
MNCMKGPLHLEHRAAGTKLSAVSSSSCHHPQPLAMASVLAPGQPRSLDSSKHRLEVHTISDTSSPEAAEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 60961 - protein, 317 aa, Homo sapiens
  Payload ID: 12193
  Gene Symbol: PITX2
  Gene Name: paired-like homeodomain 2
  Uniprot ID: Q99697
  ENSP ID: ENSP00000347004
METNCRKLVSACVQLGVQPAAVECLFSKDSEIKKVEFTDSPESRKEAASSKFFPRQHPGANEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 60962 - protein, 271 aa, Homo sapiens
  Payload ID: 12193
  Gene Symbol: PITX2
  Gene Name: paired-like homeodomain 2
  Uniprot ID: Q99697
  ENSP ID: ENSP00000347192
METNCRKLVSACVQLEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 60963 - protein, 174 aa, Homo sapiens
  Payload ID: 12193
  Gene Symbol: PITX2
  Gene Name: paired-like homeodomain 2
  ENSP ID: ENSP00000378095
METNCRKLVSACVQLGVQPAAVECLFSKDSEIKKVEFTDSPESRKEAASSKFFPRQHPGANGLVQESSGQMEKEGAQPAGRAMQEWLRAAVQWAHAALRRHVPRLFLQQLGRQGPYIRLPIHQELPLLQLYERQPPVITEHVFPTQLYLVHEHVVQHGALSSDRRPGLQSQQPE

SEQ ID NO: 60964 - protein, 317 aa, Homo sapiens; identical to SEQ ID NO: 60961
  Payload ID: 12193
  Gene Symbol: PITX2
  Gene Name: paired-like homeodomain 2
  Uniprot ID: Q99697
  ENSP ID: ENSP00000378097

SEQ ID NO: 60965 - protein, 290 aa, Homo sapiens
  Payload ID: 12193
  Gene Symbol: PITX2
  Gene Name: paired-like homeodomain 2
  ENSP ID: ENSP00000421454
METNCRKLVSACVQLGVQPAAVECLFSKDSEIKKVEFTDSPESRKEAASSKFFPRQHPGANEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQ

SEQ ID NO: 60966 - protein, 118 aa, Homo sapiens
  Payload ID: 12193
  Gene Symbol: PITX2
  Gene Name: paired-like homeodomain 2
  ENSP ID: ENSP00000424142
METNCRKLVSACVQLEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLM

SEQ ID NO: 60967 - protein, 264 aa, Homo sapiens
  Payload ID: 12193
  Gene Symbol: PITX2
  Gene Name: paired-like homeodomain 2
  ENSP ID: ENSP00000475617
MNCMKGPLHLEHRAAGTKLSAVSSSSCHHPQPLAMASVLAPGQPRSLDSSKHRLEVHTISDTSSPEAAEKDKSQQGKNEDVGAEDPSKKKRQRRQRTHFTSQQLQELEATFQRNRYPDMSTREEIAVWTNLTEARVRVGASTESGRDGGRMLWRYRPSRPGENVEGSAAWEGAGGAQLCKGRRPRGGLVARLQFPLRGRQDCRPGSGSQSGTGSLPRHPAISRAGLHGQSPAQDIVFLACSCQSRANKIPTRPRAANRLQPVSL

SEQ ID NO: 60968 - protein, 317 aa, Homo sapiens; identical to SEQ ID NO: 60961
  Payload ID: 12193
  Gene Symbol: PITX2
  Gene Name: paired-like homeodomain 2
  Uniprot ID: Q99697
  ENSP ID: ENSP00000481951

SEQ ID NO: 60969 - protein, 317 aa, Homo sapiens; identical to SEQ ID NO: 60961
  Payload ID: 12193
  Gene Symbol: PITX2
  Gene Name: paired-like homeodomain 2
  Uniprot ID: Q99697
  ENSP ID: ENSP00000484763

SEQ ID NO: 60970 - protein, 271 aa, Homo sapiens; identical to SEQ ID NO: 60962
  Payload ID: 12193
  Gene Symbol: PITX2
  Gene Name: paired-like homeodomain 2
  Uniprot ID: Q99697
  ENSP ID: ENSP00000484909

SEQ ID NO: 60971 - protein, 302 aa, Homo sapiens
  Payload ID: 12194
  Gene Symbol: PITX3
  Gene Name: paired-like homeodomain 3
  Uniprot ID: O75364
  ENSP ID: ENSP00000359019
MEFGLLSEAEARSPALSLSDAGTPHPQLPEHGCKGQEHSDSEKASASLPGGSPEDGSLKKKQRRQRTHFTSQQLQELEATFQRNRYPDMSTREEIAVWTNLTEARVRVWFKNRRAKWRKRERSQQAELCKGSFAAPLGGLVPPYEEVYPGYSYGNWPPKALAPPLAAKTFPFAFNSVNVGPLASQPVFSPPSSIAASMVPSAAAAPGTVPGPGALQGLGGGPPGLAPAAVSSGAVSCPYASAAAAAAAAASSPYVYRDPCNSSLASLRLKAKQHASFSYPAVHGPPPAANLSPCQYAVERPV

SEQ ID NO: 60972 - protein, 302 aa, Homo sapiens; identical to SEQ ID NO: 60971
  Payload ID: 12194
  Gene Symbol: PITX3
  Gene Name: paired-like homeodomain 3
  Uniprot ID: O75364
  ENSP ID: ENSP00000439383

SEQ ID NO: 60973 - protein, 392 aa, Homo sapiens
  Payload ID: 12195
  Gene Symbol: PAK1IP1
  Gene Name: PAK1 interacting protein 1
  Uniprot ID: Q9NWT1
  ENSP ID: ENSP00000368887
MELVAGCYEQVLFGFAVHPEPEACGDHEQWTLVADFTHHAHTASLSAVAVNSRFVVTGSKDETIHIYDMKKKIEHGALVHHSGTITCLKFYGNRHLISGAEDGLICIWDAKKWECLKSIKAHKGQVTFLSIHPSGKLALSVGTDKTLRTWNLVEGRSAFIKNIKQNAHIVEWSPRGEQYVVIIQNKIDIYQLDTASISGTITNEKRISSVKFLSESVLAVAGDEEVIRFFDCDSLVCLCEFKAHENRVKDMFSFEIPEHHVIVSASSDGFIKMWKLKQDKKVPPSLLCEINTNARLTCLGVWLDKVADMKESLPPAAEPSPVSKEQSKIGKKEPGDTVHKEEKRSKPNTKKRGLTGDSKKATKESGLISTKKRKMVEMLEKKRKKKKIKTMQ

SEQ ID NO: 60974 - protein, 1106 aa, Homo sapiens
  Payload ID: 12196
  Gene Symbol: PALLD
  Gene Name: palladin, cytoskeletal associated protein
  Uniprot ID: Q8WX93
  ENSP ID: ENSP00000261509
MSGTSSHESFYDSLSDMQEESKNTDFFPGLSAFLSQEEINKSLDLARRAIADSETEDFDSEKEISQIFSTSPASLCEHPSHKETKLGEHASRRPQDNRSTPVQPLAEKQTKSISSPVSKRKPAMSPLLTRPSYIRSLRKAEKRGAKTPSTNVKPKTPHQRKGGPQSQLCDKAANLIEELTSIFKAAKPRNRSPNGESSSPDSGYLSPKNQPSALLSASASQSPMEDQGEMEREVKSPGARHCYQDNQDLAVPHNRKSHPQPHSALHFPAAPRFIQKLRSQEVAEGSRVYLECRVTGNPTPRVRWFCEGKELHNTPDIQIHCEGGDLHTLIIAEAFEDDTGRYTCLATNPSGSDTTSAEVFIEGASSTDSDSESLAFKSRAGAMPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQGSEIQDSPDFRILQKKPRSTAEPEEICTLVIAETFPEDAGIFTCSARNDYGSATSTAQLVVTSANTENCSYESMGESNNDHFQHFPPPPPILETSSLELASKKPSEIQQVNNPELGLSRAALQMQFNAAERETNGVHPSRGVNGLINGKANSNKSLPTPAVLLSPTKEPPPLLAKPKLGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYISRH

SEQ ID NO: 60975 - protein, 164 aa, Homo sapiens
  Payload ID: 12196
  Gene Symbol: PALLD
  Gene Name: palladin, cytoskeletal associated protein
  ENSP ID: ENSP00000377327
MARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAV

SEQ ID NO: 60976 - protein, 71 aa, Homo sapiens
  Payload ID: 12196
  Gene Symbol: PALLD
  Gene Name: palladin, cytoskeletal associated protein
  ENSP ID: ENSP00000422016
MPQAQKKTTSVSLTIGSSSPKTGVTTAVIQPLSVPVQQVHSPTSYLCRPDGTTTAYFPPVFTKELQNTAVA

SEQ ID NO: 60977 - protein, 90 aa, Homo sapiens
  Payload ID: 12196
  Gene Symbol: PALLD
  Gene Name: palladin, cytoskeletal associated protein
  ENSP ID: ENSP00000422135
MARRLLGADSATVFNIQEPEEETANQEYKVSSCEQRLISEIEYRLERSPVDESGDEVQYGDVPVENGMAPFFEMKLKHYKIFEGMPVTFT

SEQ ID NO: 60978 - protein, 512 aa, Homo sapiens
  Payload ID: 12196
  Gene Symbol: PALLD
  Gene Name: palladin, cytoskeletal associated protein
  ENSP ID: ENSP00000423063
KNTDFFPGLSAFLSQEEINKSLDLARRAIADSETEDFDSEKEISQIFSTSPASLCEHPSHKETKLGEHASRRPQDNRSTPVQPLAEKQTKSISSPVSKRKPAMSPLLTRPSYIRSLRKAEKRGAKTPSTNVKPKTPHQRKGGPQSQLCDKAANLIEELTSIFKAAKPRNRSPNGESSSPDSGYLSPKNQPSALLSASASQSPMEDQGEMEREVKSPGARHCYQDNQDLAVPHNRKSHPQPHSALHFPAAPRFIQKLRSQEVAEGSRVYLECRVTGNPTPRVRWFCEGKELHNTPDIQIHCEGGDLHTLIIAEAFEDDTGRYTCLATNPSGSDTTSAEVFIEGASSTDSDSESLAFKSRAGAMPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQGSEIQDSPDFRILQKKPRSTAEPDVLYVFVRVRCHQMKIQYYNLAHLISSWLSSFL

SEQ ID NO: 60979 - protein, 28 aa, Homo sapiens
  Payload ID: 12196
  Gene Symbol: PALLD
  Gene Name: palladin, cytoskeletal associated protein
  ENSP ID: ENSP00000423640
MSGTSSHESFYDSLSDMQEESKNTDFFP

SEQ ID NO: 60980 - protein, 672 aa, Homo sapiens
  Payload ID: 12196
  Gene Symbol: PALLD
  Gene Name: palladin, cytoskeletal associated protein
  Uniprot ID: Q8WX93
  ENSP ID: ENSP00000424016
MSALASRSAPAMQSSGSFNYARPKQFIAAQNLGPASGHGTPASSPSSSSLPSPMSPTPRQFGRAPVPPFAQPFGAEPEAPWGSSSPSPPPPPPPVFSPTAAFPVPDVFPLPPPPPPLPSPGQASHCSSPATRFGHSQTPAAFLSALLPSQPPPAAVNALGLPKGVTPAGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYTQWHQQSQSTKPKKVRPSASRYAALSDQGLDIKAAFQPEANPSHLTLNTALVESEDL

SEQ ID NO: 60981 - protein, 83 aa, Homo sapiens
  Payload ID: 12196
  Gene Symbol: PALLD
  Gene Name: palladin, cytoskeletal associated protein
  ENSP ID: ENSP00000424121
MPQAQKKTTSVSLTIGSSSPKTGVTTAVIQPLSVPVQQVHSPTSYLCRPDGTTTAYFPPVFTKELQNTAVAEGQVVVLECRVR

SEQ ID NO: 60982 - protein, 96 aa, Homo sapiens
  Payload ID: 12196
  Gene Symbol: PALLD
  Gene Name: palladin, cytoskeletal associated protein
  ENSP ID: ENSP00000424288
MPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQG

SEQ ID NO: 60983 - protein, 1123 aa, Homo sapiens
  Payload ID: 12196
  Gene Symbol: PALLD
  Gene Name: palladin, cytoskeletal associated protein
  Uniprot ID: Q8WX93
  ENSP ID: ENSP00000425556
MSGTSSHESFYDSLSDMQEESKNTDFFPGLSAFLSQEEINKSLDLARRAIADSETEDFDSEKEISQIFSTSPASLCEHPSHKETKLGEHASRRPQDNRSTPVQPLAEKQTKSISSPVSKRKPAMSPLLTRPSYIRSLRKAEKRGAKTPSTNVKPKTPHQRKGGPQSQLCDKAANLIEELTSIFKAAKPRNRSPNGESSSPDSGYLSPKNQPSALLSASASQSPMEDQGEMEREVKSPGARHCYQDNQDLAVPHNRKSHPQPHSALHFPAAPRFIQKLRSQEVAEGSRVYLECRVTGNPTPRVRWFCEGKELHNTPDIQIHCEGGDLHTLIIAEAFEDDTGRYTCLATNPSGSDTTSAEVFIEGASSTDSDSESLAFKSRAGAMPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQGSEIQDSPDFRILQKKPRSTAEPEEICTLVIAETFPEDAGIFTCSARNDYGSATSTAQLVVTSANTENCSYESMGESNNDHFQHFPPPPPILETSSLELASKKPSEIQQVNNPELGLSRAALQMQFNAAERETNGVHPSRGVNGLINGKANSNKSLPTPAVLLSPTKEPPPLLAKPKLGFPKKASRTARIASDEEIQGTKDAVIQDLERKLRFKEDLLNNGQPRLTYEERMARRLLGADSATVFNIQEPEEETANQDIGSPHASVGSPLDGQKEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYISRH

SEQ ID NO: 60984 - protein, 160 aa, Homo sapiens
  Payload ID: 12196
  Gene Symbol: PALLD
  Gene Name: palladin, cytoskeletal associated protein
  ENSP ID: ENSP00000425729
  MOD_RES (1)..(1): Any amino acid
XGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYISRH

SEQ ID NO: 60985 - protein, 777 aa, Homo sapiens
  Payload ID: 12196
  Gene Symbol: PALLD
  Gene Name: palladin, cytoskeletal associated protein
  Uniprot ID: Q8WX93
  ENSP ID: ENSP00000426947
MPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQGSEIQDSPDFRILQKKPRSTAEPEEICTLVIAETFPEDAGIFTCSARNDYGSATSTAQLVVTSANTENCSYESMGESNNDHFQHFPPPPPILETSSLELASKKPSEIQQVNNPELGLSRAALQMQFNAAERETNGVHPSRGVNGLINGKANSNKSLPTPAVLLSPTKEPPPLLAKPKLGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYTQWHQQSQSTKPKKVRPSASRYAALSDQGLDIKAAFQPEANPSHLTLNTALVESEDL

SEQ ID NO: 60986 - protein, 1090 aa, Homo sapiens
  Payload ID: 12197
  Gene Symbol: PALM2-AKAP2
  Gene Name: PALM2-AKAP2 readthrough
  ENSP ID: ENSP00000305861
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 60987 - protein, 1103 aa, Homo sapiens
  Payload ID: 12197
  Gene Symbol: PALM2-AKAP2
  Gene Name: PALM2-AKAP2 readthrough
  ENSP ID: ENSP00000363654
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSYTSKLLSCKVTSEVLEATRVNRRKSALALRWEAGIYANQEEEDNE

SEQ ID NO: 60988 - protein, 433 aa, Homo sapiens
  Payload ID: 12197
  Gene Symbol: PALM2-AKAP2
  Gene Name: PALM2-AKAP2 readthrough
  ENSP ID: ENSP00000397839
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGVGWENVLLKEGESASNATETSGPDMTIKKPPQLSE

SEQ ID NO: 60989 - protein, 551 aa, Homo sapiens
  Payload ID: 12198
  Gene Symbol: PALMD
  Gene Name: palmdelphin
  Uniprot ID: Q9NP74
  ENSP ID: ENSP00000263174
MEEAELVKGRLQAITDKRKIQEEISQKRLKIEEDKLKHQHLKKKALREKWLLDGISSGKEQEEMKKQNQQDQHQIQVLEQSILRLEKEIQDLEKAELQISTKEEAILKKLKSIERTTEDIIRSVKVEREERAEESIEDIYANIPDLPKSYIPSRLRKEINEEKEDDEQNRKALYAMEIKVEKDLKTGESTVLSSIPLPSDDFKGTGIKVYDDGQKSVYAVSSNHSAAYNGTDGLAPVEVEELLRQASERNSKSPTEYHEPVYANPFYRPTTPQRETVTPGPNFQERIKIKTNGLGIGVNESIHNMGNGLSEERGNNFNHISPIPPVPHPRSVIQQAEEKLHTPQKRLMTPWEESNVMQDKDAPSPKPRLSPRETIFGKSEHQNSSPTCQEDEEDVRYNIVHSLPPDINDTEPVTMIFMGYQQAEDSEEDKKFLTGYDGIIHAELVVIDDEEEEDEGEAEKPSYHPIAPHSQVYQPAKPTPLPRKRSEASPHENTNHKSPHKNSISLKEQEESLGSPVHHSPFDAQTTGDGTEDPSLTALRMRMAKLGKKVI

SEQ ID NO: 60990 - protein, 551 aa, Homo sapiens
  Payload ID: 12198
  Gene Symbol: PALMD
  Gene Name: palmdelphin
  ENSP ID: ENSP00000473839
MEEAELVKGRLQAITDKRKIQEEISQKRLKIEEDKLKHQHLKKKALREKWLLDGISSGKEQEEMKKQNQQDQHQIQVLEQSILRLEKEIQDLEKAELQISTKEEAILKKLKSIERTTEDIIRSVKVEREERAEESIEDIYANIPDLPKSYIPSRLRKEINEEKEDDEQNRKALYAMEIKVEKDLKTGESTVLSSIPLPSDDFKGTGIKVYDDGQKSVYAVSSNHSAAYNGTDGLAPVEVEELLRQASERNSKSPTEYHEPVYANPFYRPTTPQRETVTPGPNFQERIKIKTNGLGIGVNESIHNMGNGLSEERGNNFNHISPIPPVPHPRSVIQQAEEKLHTPQKRLMTPWEESNVMQDKDAPSPKPRLSPRETIFGKSEHQNSSPTCQEDEEDVRYNIVHSLPPDINDTEPVTMIFMGYQQAEDSEEDKKFLTGYDGIIHAELVVIDDEEEEDEGEAEKPSYHPIAPHSQVYQPAKPTPLPRKRSEASPHENTNHKSPHKNSISLKEQEESLGSPVHHSPFDAQTTGDGTEDPSLTGNKNDKACHCCSVM

SEQ ID NO: 60991 - protein, 471 aa, Homo sapiens
  Payload ID: 12198
  Gene Symbol: PALMD
  Gene Name: palmdelphin
  Uniprot ID: Q9NP74
  ENSP ID: ENSP00000479820
MASRWNQQRKRTGRDEEAKSTKEEAILKKLKSIERTTEDIIRSVKVEREERAEESIEDIYANIPDLPKSYIPSRLRKEINEEKEDDEQNRKALYAMEIKVEKDLKTGESTVLSSIPLPSDDFKGTGIKVYDDGQKSVYAVSSNHSAAYNGTDGLAPVEVEELLRQASERNSKSPTEYHEPVYANPFYRPTTPQRETVTPGPNFQERIKIKTNGLGIGVNESIHNMGNGLSEERGNNFNHISPIPPVPHPRSVIQQAEEKLHTPQKRLMTPWEESNVMQDKDAPSPKPRLSPRETIFGKSEHQNSSPTCQEDEEDVRYNIVHSLPPDINDTEPVTMIFMGYQQAEDSEEDKKFLTGYDGIIHAELVVIDDEEEEDEGEAEKPSYHPIAPHSQVYQPAKPTPLPRKRSEASPHENTNHKSPHKNSISLKEQEESLGSPVHHSPFDAQTTGDGTEDPSLTALRMRMAKLGKKVI

SEQ ID NO: 60992 - protein, 271 aa, Homo sapiens
  Payload ID: 12199
  Gene Symbol: PPT1
  Gene Name: palmitoyl-protein thioesterase 1
  ENSP ID: ENSP00000361865
MASPGCLWLLAVALLPWTCASRALQHLDPPAPLPLVIWHGMGSRYVAQTGLELLASSNPPASSYQSAGMIGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSE

SEQ ID NO: 60993 - protein, 203 aa, Homo sapiens
  Payload ID: 12199
  Gene Symbol: PPT1
  Gene Name: palmitoyl-protein thioesterase 1
  Uniprot ID: P50897
  ENSP ID: ENSP00000392293
MASPGCLWLLAVALLPWTCASRALQHLDPPAPLPLVIWHGMGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 60994 - protein, 306 aa, Homo sapiens
  Payload ID: 12199
  Gene Symbol: PPT1
  Gene Name: palmitoyl-protein thioesterase 1
  Uniprot ID: P50897
  ENSP ID: ENSP00000394863
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 60995 - protein, 177 aa, Homo sapiens
  Payload ID: 12199
  Gene Symbol: PPT1
  Gene Name: palmitoyl-protein thioesterase 1
  ENSP ID: ENSP00000403207
QQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEDRLGLKEMDNAGQLVFLATEGDHLQLSEEWFYAHIIPFLG

SEQ ID NO: 60996 - protein, 148 aa, Homo sapiens
  Payload ID: 12199
  Gene Symbol: PPT1
  Gene Name: palmitoyl-protein thioesterase 1
  ENSP ID: ENSP00000431655
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQVPCA

SEQ ID NO: 60997 - protein, 306 aa, Homo sapiens; identical to SEQ ID NO: 60994
  Payload ID: 12199
  Gene Symbol: PPT1
  Gene Name: palmitoyl-protein thioesterase 1
  Uniprot ID: P50897
  ENSP ID: ENSP00000432053

SEQ ID NO: 60998 - protein, 87 aa, Homo sapiens
  Payload ID: 12199
  Gene Symbol: PPT1
  Gene Name: palmitoyl-protein thioesterase 1
  ENSP ID: ENSP00000434007
MALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 60999 - protein, 98 aa, Homo sapiens
  Payload ID: 12199
  Gene Symbol: PPT1
  Gene Name: palmitoyl-protein thioesterase 1
  ENSP ID: ENSP00000436481
MGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFG

SEQ ID NO: 61000 - protein, 204 aa, Homo sapiens
  Payload ID: 12199
  Gene Symbol: PPT1
  Gene Name: palmitoyl-protein thioesterase 1
  ENSP ID: ENSP00000436695
MASPGCLWLLAVALLPWTCASRALQHLDPPAPLPLVIWHGMGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQ

SEQ ID NO: 61001 - protein, 302 aa, Homo sapiens
  Payload ID: 12200
  Gene Symbol: PPT2
  Gene Name: palmitoyl-protein thioesterase 2
  Uniprot ID: Q9UMR5
  ENSP ID: ENSP00000320528
MLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 61002 - protein, 308 aa, Homo sapiens
  Payload ID: 12200
  Gene Symbol: PPT2
  Gene Name: palmitoyl-protein thioesterase 2
  Uniprot ID: Q9UMR5
  ENSP ID: ENSP00000354608
MKSCGSMLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 61003 - protein, 302 aa, Homo sapiens; identical to SEQ ID NO: 61001
  Payload ID: 12200
  Gene Symbol: PPT2
  Gene Name: palmitoyl-protein thioesterase 2
  Uniprot ID: Q9UMR5
  ENSP ID: ENSP00000364279

SEQ ID NO: 61004 - protein, 302 aa, Homo sapiens; identical to SEQ ID NO: 61001
  Payload ID: 12200
  Gene Symbol: PPT2
  Gene Name: palmitoyl-protein thioesterase 2
  Uniprot ID: Q9UMR5
  ENSP ID: ENSP00000364285

SEQ ID NO: 61005 - protein, 308 aa, Homo sapiens
  Payload ID: 12200
  Gene Symbol: PPT2
  Gene Name: palmitoyl-protein thioesterase 2
  ENSP ID: ENSP00000372637
MKSCGSMLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 61006 - protein, 308 aa, Homo sapiens
  Payload ID: 12200
  Gene Symbol: PPT2
  Gene Name: palmitoyl-protein thioesterase 2
  Uniprot ID: Q9UMR5
  ENSP ID: ENSP00000372789
MKSCGSMLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 61007 - protein, 302 aa, Homo sapiens; identical to SEQ ID NO: 61001
  Payload ID: 12200
  Gene Symbol: PPT2
  Gene Name: palmitoyl-protein thioesterase 2
  Uniprot ID: Q9UMR5
  ENSP ID: ENSP00000378894

SEQ ID NO: 61008 - protein, 302 aa, Homo sapiens
  Payload ID: 12200
  Gene Symbol: PPT2
  Gene Name: palmitoyl-protein thioesterase 2
  ENSP ID: ENSP00000382568
MLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 61009 - protein, 302 aa, Homo sapiens; identical to SEQ ID NO: 61008
  Payload ID: 12200
  Gene Symbol: PPT2
  Gene Name: palmitoyl-protein thioesterase 2
  ENSP ID: ENSP00000382570

SEQ ID NO: 61010 - protein, 302 aa, Homo sapiens; identical to SEQ ID NO: 61008
  Payload ID: 12200
  Gene Symbol: PPT2
  Gene Name: palmitoyl-protein thioesterase 2
  ENSP ID: ENSP00000382573

SEQ ID NO: 61011 - protein, 302 aa, Homo sapiens
  Payload ID: 12200
  Gene Symbol: PPT2
  Gene Name: palmitoyl-protein thioesterase 2
  ENSP ID: ENSP00000382748
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 61012 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000382749

SEQ ID NO: 61013 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000382750

SEQ ID NO: 61014 - protein, 200 aa, Homo sapiens
  Payload ID: 12200
  Gene Symbol: PPT2
  Gene Name: palmitoyl-protein thioesterase 2
  ENSP ID: ENSP00000387444
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALING

SEQ ID NO: 61015 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000388341

SEQ ID NO: 61016 - protein, 97 aa, Homo sapiens
  Payload ID: 12200
  Gene Symbol: PPT2
  Gene Name: palmitoyl-protein thioesterase 2
  ENSP ID: ENSP00000388444
MLGLWGQRLPAAWVLLLLPFLPLLLLAAPAPHRASYKPVIVVHGLFDSSYSFRHLLEYINEGALCAGLCFLSWMITTWILSSPSPLHRWDSMETRTT

SEQ ID NO: 61017 - protein, 93 aa, Homo sapiens
  Payload ID: 12200
  Gene Symbol: PPT2
  Gene Name: palmitoyl-protein thioesterase 2
  ENSP ID: ENSP00000389505
MLGLWGQRLPAAWVLLLLPFLPLLLLAAPAPHRESYKPVIVVHGLFDSSYSFRHLLEYINEGALCAGLCFLSWMITTWILSSPSPLHRWDSME

SEQ ID NO: 61018 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000389930

SEQ ID NO: 61019 - protein, 200 aa, Homo sapiens; identical to SEQ ID NO: 61014
  Payload ID: 12200
  Gene Symbol: PPT2
  Gene Name: palmitoyl-protein thioesterase 2
  ENSP ID: ENSP00000392069

SEQ ID NO: 61020 - protein, 236 aa, Homo sapiens
  Payload ID: 12200
  Gene Symbol: PPT2
  Gene Name: palmitoyl-protein thioesterase 2
  ENSP ID: ENSP00000392744
MLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQS

SEQ ID NO: 61021 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000392885

SEQ ID NO: 61022 - protein, 236 aa, Homo sapiens; identical to SEQ ID NO: 61020
  Payload ID: 12200
  Gene Symbol: PPT2
  Gene Name: palmitoyl-protein thioesterase 2
  ENSP ID: ENSP00000393629

SEQ ID NO: 61023 - protein, 158 aa, Homo sapiens
  Payload ID: 12200
  Gene Symbol: PPT2
  Gene Name: palmitoyl-protein thioesterase 2
  ENSP ID: ENSP00000393813
MLGLWGQRLPAAWVLLLLPFLPLLLLAAPAPHRASYKPVIVVHGLFDSSYSFRHLLEYINEMGQYGDTDYLKWLFPTSMRSNLYRICYSPWGQEFSICNYWHDPHHDDLYLNASSFLALINGERDHPNATVWRKNFLRVGHLVLIGGPDDGVITPWQS

SEQ ID NO: 61024 - protein, 93 aa, Homo sapiens
  Payload ID: 12200
  Gene Symbol: PPT2
  Gene Name: palmitoyl-protein thioesterase 2
  ENSP ID: ENSP00000395212
MLGLWGQRLPAAWVLLLLPFLPLLLLAAPAPHRASYKPVIVVHGLFDSSYSFRHLLEYINEGALCAGLCFLSWMITTWILSSPSPLHRWDSME

SEQ ID NO: 61025 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000395242

SEQ ID NO: 61026 - protein, 180 aa, Homo sapiens
  Payload ID: 12200
  Gene Symbol: PPT2
  Gene Name: palmitoyl-protein thioesterase 2
  ENSP ID: ENSP00000395322
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWH

SEQ ID NO: 61027 - protein, 97 aa, Homo sapiens
  Payload ID: 12200
  Gene Symbol: PPT2
  Gene Name: palmitoyl-protein thioesterase 2
  ENSP ID: ENSP00000395456
MLGLCGQRLPAAWVLLLLPFLPLLLLAAPAPHRASYKPVIVVHGLFDSSYSFRHLLEYINEGALCAGLCFLSWMITTWILSSPSPLHRWDSMETRTT

SEQ ID NO: 61028 - protein, 93 aa, Homo sapiens; identical to SEQ ID NO: 61017
  Payload ID: 12200
  Gene Symbol: PPT2
  Gene Name: palmitoyl-protein thioesterase 2
  ENSP ID: ENSP00000396015

SEQ ID NO: 61029 - protein, 158 aa, Homo sapiens; identical to SEQ ID NO: 61023
  Payload ID: 12200
  Gene Symbol: PPT2
  Gene Name: palmitoyl-protein thioesterase 2
  ENSP ID: ENSP00000396541

SEQ ID NO: 61030 - protein, 236 aa, Homo sapiens; identical to SEQ ID NO: 61020
  Payload ID: 12200
  Gene Symbol: PPT2
  Gene Name: palmitoyl-protein thioesterase 2
  ENSP ID: ENSP00000397037

SEQ ID NO: 61031 - protein, 158 aa, Homo sapiens; identical to SEQ ID NO: 61023
  Payload ID: 12200
  Gene Symbol: PPT2
  Gene Name: palmitoyl-protein thioesterase 2
  ENSP ID: ENSP00000397767

SEQ ID NO: 61032 - protein, 308 aa, Homo sapiens; identical to SEQ ID NO: 61006
  Payload ID: 12200
  Gene Symbol: PPT2
  Gene Name: palmitoyl-protein thioesterase 2
  Uniprot ID: Q9UMR5
  ENSP ID: ENSP00000398462

SEQ ID NO: 61033 - protein, 180 aa, Homo sapiens
  Payload ID: 12200
  Gene Symbol: PPT2
  Gene Name: palmitoyl-protein thioesterase 2
  ENSP ID: ENSP00000398847
MLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWH

SEQ ID NO: 61034 - protein, 180 aa, Homo sapiens; identical to SEQ ID NO: 61026
  Payload ID: 12200
  Gene Symbol: PPT2
  Gene Name: palmitoyl-protein thioesterase 2
  ENSP ID: ENSP00000399320

SEQ ID NO: 61035 - protein, 158 aa, Homo sapiens
  Payload ID: 12200
  Gene Symbol: PPT2
  Gene Name: palmitoyl-protein thioesterase 2
  ENSP ID: ENSP00000399332
MLGLWGQRLPAAWVLLLLPFLPLLLLAAPAPHRESYKPVIVVHGLFDSSYSFRHLLEYINEMGQYGDTDYLKWLFPTSMRSNLYRICYSPWGQEFSICNYWHDPHHDDLYLNASSFLALINGERDHPNATVWRKNFLRVGHLVLIGGPDDGVITPWQS

SEQ ID NO: 61036 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000399879

SEQ ID NO: 61037 - protein, 180 aa, Homo sapiens
  Payload ID: 12200
  Gene Symbol: PPT2
  Gene Name: palmitoyl-protein thioesterase 2
  ENSP ID: ENSP00000402159
MLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWH

SEQ ID NO: 61038 - protein, 180 aa, Homo sapiens; identical to SEQ ID NO: 61026
  Payload ID: 12200
  Gene Symbol: PPT2
  Gene Name: palmitoyl-protein thioesterase 2
  ENSP ID: ENSP00000402642

SEQ ID NO: 61039 - protein, 180 aa, Homo sapiens; identical to SEQ ID NO: 61037
  Payload ID: 12200
  Gene Symbol: PPT2
  Gene Name: palmitoyl-protein thioesterase 2
  ENSP ID: ENSP00000403457

SEQ ID NO: 61040 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000403820

SEQ ID NO: 61041 - protein, 200 aa, Homo sapiens; identical to SEQ ID NO: 61014
  Payload ID: 12200
  Gene Symbol: PPT2
  Gene Name: palmitoyl-protein thioesterase 2
  ENSP ID: ENSP00000404636

SEQ ID NO: 61042 - protein, 93 aa, Homo sapiens; identical to SEQ ID NO: 61024
  Payload ID: 12200
  Gene Symbol: PPT2
  Gene Name: palmitoyl-protein thioesterase 2
  ENSP ID: ENSP00000405444

SEQ ID NO: 61043 - protein, 200 aa, Homo sapiens; identical to SEQ ID NO: 61014
  Payload ID: 12200
  Gene Symbol: PPT2
  Gene Name: palmitoyl-protein thioesterase 2
  ENSP ID: ENSP00000405631

SEQ ID NO: 61044 - protein, 308 aa, Homo sapiens; identical to SEQ ID NO: 61006
  Payload ID: 12200
  Gene Symbol: PPT2
  Gene Name: palmitoyl-protein thioesterase 2
  Uniprot ID: Q9UMR5
  ENSP ID: ENSP00000406219

SEQ ID NO: 61045 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000406496

SEQ ID NO: 61046 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000406566

SEQ ID NO: 61047 - protein, 200 aa, Homo sapiens
  Payload ID: 12200
  Gene Symbol: PPT2
  Gene Name: palmitoyl-protein thioesterase 2
  Uniprot ID: Q9UMR5
  ENSP ID: ENSP00000408333
MLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALING

SEQ ID NO: 61048 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000408703

SEQ ID NO: 61049 - protein, 158 aa, Homo sapiens; identical to SEQ ID NO: 61023
  Payload ID: 12200
  Gene Symbol: PPT2
  Gene Name: palmitoyl-protein thioesterase 2
  ENSP ID: ENSP00000409058

SEQ ID NO: 61050 - protein, 180 aa, Homo sapiens; identical to SEQ ID NO: 61026
  Payload ID: 12200
  Gene Symbol: PPT2
  Gene Name: palmitoyl-protein thioesterase 2
  ENSP ID: ENSP00000409804

SEQ ID NO: 61051 - protein, 200 aa, Homo sapiens; identical to SEQ ID NO: 61014
  Payload ID: 12200
  Gene Symbol: PPT2
  Gene Name: palmitoyl-protein thioesterase 2
  ENSP ID: ENSP00000409821

SEQ ID NO: 61052 - protein, 158 aa, Homo sapiens
  Payload ID: 12200
  Gene Symbol: PPT2
  Gene Name: palmitoyl-protein thioesterase 2
  ENSP ID: ENSP00000409877
MLGLCGQRLPAAWVLLLLPFLPLLLLAAPAPHRASYKPVIVVHGLFDSSYSFRHLLEYINEMGQYGDTDYLKWLFPTSMRSNLYRICYSPWGQEFSICNYWHDPHHDDLYLNASSFLALINGERDHPNATVWRKNFLRVGHLVLIGGPDDGVITPWQS

SEQ ID NO: 61053 - protein, 200 aa, Homo sapiens; identical to SEQ ID NO: 61047
  Payload ID: 12200
  Gene Symbol: PPT2
  Gene Name: palmitoyl-protein thioesterase 2
  Uniprot ID: Q9UMR5
  ENSP ID: ENSP00000410001

SEQ ID NO: 61054 - protein, 158 aa, Homo sapiens; identical to SEQ ID NO: 61023
  Payload ID: 12200
  Gene Symbol: PPT2
  Gene Name: palmitoyl-protein thioesterase 2
  ENSP ID: ENSP00000410212

SEQ ID NO: 61055 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000411007

SEQ ID NO: 61056 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000411625

SEQ ID NO: 61057 - protein, 180 aa, Homo sapiens; identical to SEQ ID NO: 61026
  Payload ID: 12200
  Gene Symbol: PPT2
  Gene Name: palmitoyl-protein thioesterase 2
  ENSP ID: ENSP00000412655

SEQ ID NO: 61058 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000412827

SEQ ID NO: 61059 - protein, 158 aa, Homo sapiens; identical to SEQ ID NO: 61035
  Payload ID: 12200
  Gene Symbol: PPT2
  Gene Name: palmitoyl-protein thioesterase 2
  ENSP ID: ENSP00000412844

SEQ ID NO: 61060 - protein, 93 aa, Homo sapiens; identical to SEQ ID NO: 61024
  Payload ID: 12200
  Gene Symbol: PPT2
  Gene Name: palmitoyl-protein thioesterase 2
  ENSP ID: ENSP00000414838

SEQ ID NO: 61061 - protein, 93 aa, Homo sapiens; identical to SEQ ID NO: 61024
  Payload ID: 12200
  Gene Symbol: PPT2
  Gene Name: palmitoyl-protein thioesterase 2
  ENSP ID: ENSP00000415798

SEQ ID NO: 61062 - protein, 242 aa, Homo sapiens
  Payload ID: 12200
  Gene Symbol: PPT2
  Gene Name: palmitoyl-protein thioesterase 2
  ENSP ID: ENSP00000416062
MKSCGSMLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQS

SEQ ID NO: 61063 - protein, 308 aa, Homo sapiens; identical to SEQ ID NO: 61006
  Payload ID: 12200
  Gene Symbol: PPT2
  Gene Name: palmitoyl-protein thioesterase 2
  Uniprot ID: Q9UMR5
  ENSP ID: ENSP00000416505

SEQ ID NO: 61064 - protein, 127 aa, Homo sapiens; identical to SEQ ID NO: 22457
  Payload ID: 12200
  Gene Symbol: PPT2
  Gene Name: palmitoyl-protein thioesterase 2
  ENSP ID: ENSP00000431652
  MOD_RES (1)..(1): Any amino acid

SEQ ID NO: 61065 - protein, 301 aa, Homo sapiens; identical to SEQ ID NO: 22456
  Payload ID: 12200
  Gene Symbol: PPT2
  Gene Name: palmitoyl-protein thioesterase 2
  Uniprot ID: Q9UMR5
  ENSP ID: ENSP00000431928

SEQ ID NO: 61066 - protein, 301 aa, Homo sapiens; identical to SEQ ID NO: 22456
  Payload ID: 12200
  Gene Symbol: PPT2
  Gene Name: palmitoyl-protein thioesterase 2
  Uniprot ID: Q9UMR5
  ENSP ID: ENSP00000432308

SEQ ID NO: 61067 - protein, 301 aa, Homo sapiens; identical to SEQ ID NO: 22456
  Payload ID: 12200
  Gene Symbol: PPT2
  Gene Name: palmitoyl-protein thioesterase 2
  Uniprot ID: Q9UMR5
  ENSP ID: ENSP00000432502

SEQ ID NO: 61068 - protein, 127 aa, Homo sapiens; identical to SEQ ID NO: 22457
  Payload ID: 12200
  Gene Symbol: PPT2
  Gene Name: palmitoyl-protein thioesterase 2
  ENSP ID: ENSP00000432657
  MOD_RES (1)..(1): Any amino acid

SEQ ID NO: 61069 - protein, 301 aa, Homo sapiens; identical to SEQ ID NO: 22456
  Payload ID: 12200
  Gene Symbol: PPT2
  Gene Name: palmitoyl-protein thioesterase 2
  Uniprot ID: Q9UMR5
  ENSP ID: ENSP00000432964

SEQ ID NO: 61070 - protein, 301 aa, Homo sapiens; identical to SEQ ID NO: 22456
  Payload ID: 12200
  Gene Symbol: PPT2
  Gene Name: palmitoyl-protein thioesterase 2
  Uniprot ID: Q9UMR5
  ENSP ID: ENSP00000433061

SEQ ID NO: 61071 - protein, 236 aa, Homo sapiens; identical to SEQ ID NO: 61020
  Payload ID: 12200
  Gene Symbol: PPT2
  Gene Name: palmitoyl-protein thioesterase 2
  ENSP ID: ENSP00000433262

SEQ ID NO: 61072 - protein, 97 aa, Homo sapiens; identical to SEQ ID NO: 61016
  Payload ID: 12200
  Gene Symbol: PPT2
  Gene Name: palmitoyl-protein thioesterase 2
  ENSP ID: ENSP00000433272

SEQ ID NO: 61073 - protein, 301 aa, Homo sapiens; identical to SEQ ID NO: 22456
  Payload ID: 12200
  Gene Symbol: PPT2
  Gene Name: palmitoyl-protein thioesterase 2
  Uniprot ID: Q9UMR5
  ENSP ID: ENSP00000433323

SEQ ID NO: 61074 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000433696

SEQ ID NO: 61075 - protein, 301 aa, Homo sapiens; identical to SEQ ID NO: 22456
  Payload ID: 12200
  Gene Symbol: PPT2
  Gene Name: palmitoyl-protein thioesterase 2
  Uniprot ID: Q9UMR5
  ENSP ID: ENSP00000434992

SEQ ID NO: 61076 - protein, 127 aa, Homo sapiens; identical to SEQ ID NO: 22457
  Payload ID: 12200
  Gene Symbol: PPT2
  Gene Name: palmitoyl-protein thioesterase 2
  ENSP ID: ENSP00000435170
  MOD_RES (1)..(1): Any amino acid

SEQ ID NO: 61077 - protein, 54 aa, Homo sapiens
  Payload ID: 12200
  Gene Symbol: PPT2
  Gene Name: palmitoyl-protein thioesterase 2
  ENSP ID: ENSP00000435187
  MOD_RES (1)..(1): Any amino acid
XHDDLYLNASSFLALINGERDHPNATVWRKNFLRVGHLVLIGGPDDGVITPWQS

SEQ ID NO: 61078 - protein, 236 aa, Homo sapiens; identical to SEQ ID NO: 61020
  Payload ID: 12200
  Gene Symbol: PPT2
  Gene Name: palmitoyl-protein thioesterase 2
  ENSP ID: ENSP00000435258

SEQ ID NO: 61079 - protein, 127 aa, Homo sapiens; identical to SEQ ID NO: 22457
  Payload ID: 12200
  Gene Symbol: PPT2
  Gene Name: palmitoyl-protein thioesterase 2
  ENSP ID: ENSP00000435492
  MOD_RES (1)..(1): Any amino acid

SEQ ID NO: 61080 - protein, 132 aa, Homo sapiens
  Payload ID: 12200
  Gene Symbol: PPT2
  Gene Name: palmitoyl-protein thioesterase 2
  ENSP ID: ENSP00000435988
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQDGTVWRHGLLEVAVPHLHAV

SEQ ID NO: 61081 - protein, 301 aa, Homo sapiens; identical to SEQ ID NO: 22456
  Payload ID: 12200
  Gene Symbol: PPT2
  Gene Name: palmitoyl-protein thioesterase 2
  Uniprot ID: Q9UMR5
  ENSP ID: ENSP00000436963

SEQ ID NO: 61082 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000447926

SEQ ID NO: 61083 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000447950

SEQ ID NO: 61084 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000447973

SEQ ID NO: 61085 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000448392

SEQ ID NO: 61086 - protein, 302 aa, Homo sapiens; identical to SEQ ID NO: 61011
  Payload ID: 12200
  Gene Symbol: PPT2
  Gene Name: palmitoyl-protein thioesterase 2
  ENSP ID: ENSP00000448877

SEQ ID NO: 61087 - protein, 302 aa, Homo sapiens; identical to SEQ ID NO: 61008
  Payload ID: 12200
  Gene Symbol: PPT2
  Gene Name: palmitoyl-protein thioesterase 2
  ENSP ID: ENSP00000449114

SEQ ID NO: 61088 - protein, 39 aa, Homo sapiens
  Payload ID: 12200
  Gene Symbol: PPT2
  Gene Name: palmitoyl-protein thioesterase 2
  ENSP ID: ENSP00000475276
MAKAPQGVHLICYSQGGLVCRALLSVMDDHNVDSFISLS

SEQ ID NO: 61089 - protein, 132 aa, Homo sapiens; identical to SEQ ID NO: 61080
  Payload ID: 12200
  Gene Symbol: PPT2
  Gene Name: palmitoyl-protein thioesterase 2
  ENSP ID: ENSP00000475728

SEQ ID NO: 61090 - protein, 97 aa, Homo sapiens; identical to SEQ ID NO: 61016
  Payload ID: 12200
  Gene Symbol: PPT2
  Gene Name: palmitoyl-protein thioesterase 2
  ENSP ID: ENSP00000475954

SEQ ID NO: 61091 - protein, 327 aa, Homo sapiens
  Payload ID: 12201
  Gene Symbol: ZDHHC3
  Gene Name: Palmitoyltransferase ZDHHC3
  ENSP ID: ENSP00000485706
MMLIPTHHFRNIERKPEYLQPEKCVPPPYPGPVGTMWFIRDGCGIACAIVTWFLVLYAEFVVLFVMLIPSRDYVYSIINGIVFNLLAFLALASHCRAMLTDPGAVPKGNATKEFIESLQLKPGQVVYKCPKCCSIKPDRAHHCSVCKRCIRKMDHHCPWVNNCVGENNQKYFVLFTMYIALISLHALIMVGFHFLHCFEEDWTTYGLNREEMAETGISLHEKMQPLNFSSTECSSFSPPTTVILLILLCFEGLLFLIFTSVMFGTQVHSICTDETGIEQLKKEERRWAKKTKWMNMKAVFGHPFSLGWASPFATPDQGKADPYQYVV

SEQ ID NO: 61092 - protein, 60 aa, Homo sapiens
  Payload ID: 12201
  Gene Symbol: ZDHHC3
  Gene Name: Palmitoyltransferase ZDHHC3
  ENSP ID: ENSP00000485722
  MOD_RES (1)..(1): Any amino acid
XVMFGTQVHSICTDETAADDHPGRECRMPKANHLSWSLLLCQEGRPGEGPVRKQHGITCS

SEQ ID NO: 61093 - protein, 95 aa, Homo sapiens
  Payload ID: 12201
  Gene Symbol: ZDHHC3
  Gene Name: Palmitoyltransferase ZDHHC3
  ENSP ID: ENSP00000485753
MDHHCPWVNNCVGENNQKYFVLFTMYIALISLHALIMVGFHFLHCFEEDWTKCSSFSPPTTVILLILLCFEGLLFLIFTSVMFGTQVHSICTDET

SEQ ID NO: 61094 - protein, 333 aa, Homo sapiens
  Payload ID: 12201
  Gene Symbol: ZDHHC3
  Gene Name: Palmitoyltransferase ZDHHC3
  ENSP ID: ENSP00000486029
MMLIPTHHFRNIERKPEYLQPEKCVPPPYPGPVGTMWFIRDGCGIACAIVTWFLVLYAEFVVLFVMLIPSRDYVYSIINGIVFNLLAFLALASHCRAMLTDPVRTCTEMAFTLLGRGASFPEKLDKPVSGRSKCLLGAVPKGNATKEFIESLQLKPGQVVYKCPKCCSIKPDRAHHCSVCKRCIRKMDHHCPWVNNCVGENNQKYFVLFTMYIALISLHALIMVGFHFLHCFEEDWTKCSSFSPPTTVILLILLCFEGLLFLIFTSVMFGTQVHSICTDETGIEQLKKEERRWAKKTKWMNMKAVFGHPFSLGWASPFATPDQGKADPYQYVV

SEQ ID NO: 61095 - protein, 111 aa, Homo sapiens
  Payload ID: 12201
  Gene Symbol: ZDHHC3
  Gene Name: Palmitoyltransferase ZDHHC3
  ENSP ID: ENSP00000486173
  MOD_RES (1)..(1): Any amino acid
XLIPTHHFRNIERKPEYLQPEKCVPPPYPGPVGTMWFIRDGCGIACAIVTWFLVLYAEFVVLFVMLIPSRDYVYSIINGIVFNLLAFLALASHCRAMLTDPVRGSAQRKCH

SEQ ID NO: 61096 - protein, 195 aa, Homo sapiens
  Payload ID: 12201
  Gene Symbol: ZDHHC3
  Gene Name: Palmitoyltransferase ZDHHC3
  ENSP ID: ENSP00000486290
IKPDRAHHCSVCKRCIRKMDHHCPWVNNCVGENNQKYFVLFTMYIALISLHALIMVGFHFLHCFEEDWTKCSSFSPPTTVILLILLCFEGLLFLIFTSVMFGTQVHSICTDETGIERLKRKNQPREHMGSWQSVKETFGGDFSLNWFNPFSRPCQPEIPSDKDMVRQVTSLSDTETMEDPSEETKDEDSVEVTDE

SEQ ID NO: 61097 - protein, 299 aa, Homo sapiens
  Payload ID: 12201
  Gene Symbol: ZDHHC3
  Gene Name: Palmitoyltransferase ZDHHC3
  ENSP ID: ENSP00000486386
MMLIPTHHFRNIERKPEYLQPEKCVPPPYPGPVGTMWFIRDGCGIACAIVTWFLVLYAEFVVLFVMLIPSRDYVYSIINGIVFNLLAFLALASHCRAMLTDPGAVPKGNATKEFIESLQLKPGQVVYKCPKCCSIKPDRAHHCSVCKRCIRKMDHHCPWVNNCVGENNQKYFVLFTMYIALISLHALIMVGFHFLHCFEEDWTKCSSFSPPTTVILLILLCFEGLLFLIFTSVMFGTQVHSICTDETGIEQLKKEERRWAKKTKWMNMKAVFGHPFSLGWASPFATPDQGKADPYQYVV

SEQ ID NO: 61098 - protein, 44 aa, Homo sapiens
  Payload ID: 12201
  Gene Symbol: ZDHHC3
  Gene Name: Palmitoyltransferase ZDHHC3
  ENSP ID: ENSP00000486651
MDHHCPWVNNCVGENNQKYFVLFTMYIALISLHALIMVGFHFLH

SEQ ID NO: 61099 - protein, 1201 aa, Homo sapiens
  Payload ID: 12202
  Gene Symbol: PAN2
  Gene Name: PAN2 poly(A) specific ribonuclease subunit
  Uniprot ID: Q504Q3
  ENSP ID: ENSP00000257931
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHIIEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSFCSSGDSVIGQLFSCEMENCSLCRCGSETVRASSTLLFTLSYPDGSKSDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKNAAVFSSVLAL

SEQ ID NO: 61100 - protein, 1198 aa, Homo sapiens
  Payload ID: 12202
  Gene Symbol: PAN2
  Gene Name: PAN2 poly(A) specific ribonuclease subunit
  Uniprot ID: Q504Q3
  ENSP ID: ENSP00000388231
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHIIEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKNAAVFSSVLAL

SEQ ID NO: 61101 - protein, 1202 aa, Homo sapiens
  Payload ID: 12202
  Gene Symbol: PAN2
  Gene Name: PAN2 poly(A) specific ribonuclease subunit
  Uniprot ID: Q504Q3
  ENSP ID: ENSP00000401721
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHIIEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKSDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKNAAVFSSVLAL

SEQ ID NO: 61102 - protein, 111 aa, Homo sapiens
  Payload ID: 12202
  Gene Symbol: PAN2
  Gene Name: PAN2 poly(A) specific ribonuclease subunit
  ENSP ID: ENSP00000449092
MARGGLIIFDYLLDENEDMHSLLLTDSSTLLVGGLQNHIIEIDLNTVQETQKYAVETPGVTIMRQTNRFFFCGHTSGKVSLRDLRTFKVEHEFDAFSGSLSDFDVHGNLLA

SEQ ID NO: 61103 - protein, 1202 aa, Homo sapiens; identical to SEQ ID NO: 61101
  Payload ID: 12202
  Gene Symbol: PAN2
  Gene Name: PAN2 poly(A) specific ribonuclease subunit
  Uniprot ID: Q504Q3
  ENSP ID: ENSP00000449861

SEQ ID NO: 61104 - protein, 1202 aa, Homo sapiens; identical to SEQ ID NO: 61101
  Payload ID: 12202
  Gene Symbol: PAN2
  Gene Name: PAN2 poly(A) specific ribonuclease subunit
  Uniprot ID: Q504Q3
  ENSP ID: ENSP00000481859

SEQ ID NO: 61105 - protein, 887 aa, Homo sapiens
  Payload ID: 12203
  Gene Symbol: PAN3
  Gene Name: PAN3 poly(A) specific ribonuclease subunit
  Uniprot ID: Q58A45
  ENSP ID: ENSP00000370345
MNSGGGLPPPSAAASPSSSSLAAAVAVVAPPGVGGVPGGAAVGVKLKYCRYYAKDKTCFYGEECQFLHEDPAAGAAPGLGLHSNSVPLALAGAPVAGFPPGAVAGGGAGPPPGPKKPDLGDPGTGAAAGGGGSSGGLDGPRLAIPGMDGGALTDTSLTDSYFSTSFIGVNGFGSPVETKYPLMQRMTNSSSSPSLLNDSAKPYSAHDPLTSPASSLFNDFGALNISQRRKPRKYRLGMLEERLVPMGSKARKAKNPIGCLADRCKSGVPINMVWWNRVTENNLQTPNPTASEFIPKGGSTSRLSNVSQSNMSAFSQVFSHPSMGSPATAGLAPGMSLSAGSSPLHSPKITPHTSPAPRRRSHTPNPASYMVPSSASTSVNNPVSQTPSSGQVIQKETVGGTTYFYTDTTPAPLTGMVFPNYHIYPPTAPHVAYMQPKANAPSFFMADELRQELINRHLITMAQIDQADMPAVPTEVDSYHSLFPLEPLPPPNRIQKSSNFGYITSCYKAVNSKDDLPYCLRRIHGFRLVNTKCMVLVDMWKKIQHSNIVTLREVFTTKAFAEPSLVFAYDFHAGGETMMSRHFNDPNADAYFTKRKWGQHEGPLPRQHAGLLPESLIWAYIVQLSSALRTIHTAGLACRVMDPTKILITGKTRLRVNCVGVFDVLTFDNSQNNNPLALMAQYQQADLISLGKVVLALACNSLAGIQRENLQKAMELVTINYSSDLKNLILYLLTDQNRMRSVNDIMPMIGARFYTQLDAAQMRNDVIEEDLAKEVQNGRLFRLLAKLGTINERPEFQKDPTWSETGDRYLLKLFRDHLFHQVTEAGAPWIDLSHIISCLNKLDAGVPEKISLISRDEKSVLVVTYSDLKRCFENTFQELIAAANGQL

SEQ ID NO: 61106 - protein, 687 aa, Homo sapiens
  Payload ID: 12203
  Gene Symbol: PAN3
  Gene Name: PAN3 poly(A) specific ribonuclease subunit
  ENSP ID: ENSP00000382522
MDGGALTDTSLTDSYFSTSFIGVNGFGSPVETKYPLMQRMTNSSSSPSLLNDSAKPYSAHDPLTSPASSLFNDFGALNISQRRKTPNPTASEFIPKGGSTSRLSNVSQSNMSAFSQVFSHPSMGSPATAGLAPGMSLSAGSSPLHSPKITPHTSPAPRRRSHTPNPASYMVPSSASTSVNNPVSQTPSSGQVIQKETVGGTTYFYTDTTPAPLTGMVFPNYHIYPPTAPHVAYMQPKANAPSFFMADELRQELINRHLITMAQIDQADMPAVPTEVDSYHSLFPLEPLPPPNRIQKSSNFGYITSCYKAVNSKDDLPYCLRRIHGFRLVNTKCMVLVDMWKKIQHSNIVTLREVFTTKAFAEPSLVFAYDFHAGGETMMSRHFNDPNADAYFTKRKWGQHEGPLPRQHAGLLPESLIWAYIVQLSSALRTIHTAGLACRVMDPTKILITGKTRLRVNCVGVFDVLTFDNSQNNNPLALMAQYQQADLISLGKVVLALACNSLAGIQRENLQKAMELVTINYSSDLKNLILYLLTDQNRMRSVNDIMPMIGARFYTQLDAAQMRNDVIEEDLAKEVQNGRLFRLLAKLGTINERPEFQKDPTWSETGDRYLLKLFRDHLFHQVTEAGAPWIDLSHIISCLNKLDAGVPEKISLISRDEKSVLVVTYSDLKRCFENTFQELIAAANGQL

SEQ ID NO: 61107 - protein, 328 aa, Homo sapiens
  Payload ID: 12204
  Gene Symbol: PTF1A
  Gene Name: pancreas specific transcription factor, 1a
  Uniprot ID: Q7RTS3
  ENSP ID: ENSP00000365687
MDAVLLEHFPGGLDAFPSSYFDEDDFFTDQSSRDPLEDGDELLADEQAEVEFLSHQLHEYCYRDGACLLLQPAPPAAPLALAPPSSGGLGEPDDGGGGGYCCETGAPPGGFPYSPGSPPSCLAYPCAGAAVLSPGARLRGLSGAAAAAARRRRRVRSEAELQQLRQAANVRERRRMQSINDAFEGLRSHIPTLPYEKRLSKVDTLRLAIGYINFLSELVQADLPLRGGGAGGCGGPGGGGRLGGDSPGSQAQKVIICHRGTRSPSPSDPDYGLPPLAGHSLSWTDEKQLKEQNIIRTAKVWTPEDPRKLNSKSSFNNIENEPPFEFVS

SEQ ID NO: 61108 - protein, 283 aa, Homo sapiens
  Payload ID: 12205
  Gene Symbol: PDX1
  Gene Name: pancreatic and duodenal homeobox 1
  Uniprot ID: P52945
  ENSP ID: ENSP00000370421
MNGEEQYYAATQLYKDPCAFQRGPAPEFSASPPACLYMGRQPPPPPPHPFPGALGALEQGSPPDISPYEVPPLADDPAVAHLHHHLPAQLALPHPPAGPFPEGAEPGVLEEPNRVQLPFPWMKSTKAHAWKGQWAGGAYAAEPEENKRTRTAYTRAQLLELEKEFLFNKYISRPRRVELAVMLNLTERHIKIWFQNRRMKWKKEEDKKRGGGTAVGGGGVAEPEQDCAVTSGEELLALPPPPPPGGAVPPAAPVAAREGRLPPGLSASPQPSSVAPRRPQEPR

SEQ ID NO: 61109 - protein, 465 aa, Homo sapiens
  Payload ID: 12206
  Gene Symbol: PNLIP
  Gene Name: pancreatic lipase
  Uniprot ID: P16233
  ENSP ID: ENSP00000358223
MLPLWTLSLLLGAVAGKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRTGYTQASQNIRIVGAEVAYFVEFLQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCPQMGHYADRYPGKTNDVGQKFYLDTGDASNFARWRYKVSVTLSGKKVTGHILVSLFGNKGNSKQYEIFKGTLKPDSTHSNEFDSDVDVGDLQMVKFIWYNNVINPTLPRVGASKIIVETNVGKQFNFCSPETVREEVLLTLTPC

SEQ ID NO: 61110 - protein, 467 aa, Homo sapiens
  Payload ID: 12207
  Gene Symbol: PNLIPRP1
  Gene Name: pancreatic lipase-related protein 1
  Uniprot ID: P54315
  ENSP ID: ENSP00000351695
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 61111 - protein, 131 aa, Homo sapiens
  Payload ID: 12207
  Gene Symbol: PNLIPRP1
  Gene Name: pancreatic lipase-related protein 1
  ENSP ID: ENSP00000431207
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQA

SEQ ID NO: 61112 - protein, 118 aa, Homo sapiens
  Payload ID: 12207
  Gene Symbol: PNLIPRP1
  Gene Name: pancreatic lipase-related protein 1
  ENSP ID: ENSP00000431406
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKQPGASPRA

SEQ ID NO: 61113 - protein, 163 aa, Homo sapiens
  Payload ID: 12207
  Gene Symbol: PNLIPRP1
  Gene Name: pancreatic lipase-related protein 1
  ENSP ID: ENSP00000433785
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKTPGLSRITGLDPVEASFESTPEEVRLDPSDADFVDVIHTDAAPLIPFLGFGTN

SEQ ID NO: 61114 - protein, 467 aa, Homo sapiens; identical to SEQ ID NO: 61110
  Payload ID: 12207
  Gene Symbol: PNLIPRP1
  Gene Name: pancreatic lipase-related protein 1
  Uniprot ID: P54315
  ENSP ID: ENSP00000433933

SEQ ID NO: 61115 - protein, 467 aa, Homo sapiens
  Payload ID: 12207
  Gene Symbol: PNLIPRP1
  Gene Name: pancreatic lipase-related protein 1
  ENSP ID: ENSP00000434159
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLVKYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 61116 - protein, 179 aa, Homo sapiens
  Payload ID: 12207
  Gene Symbol: PNLIPRP1
  Gene Name: pancreatic lipase-related protein 1
  ENSP ID: ENSP00000434549
KLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGQVLPVSRSRMPTDGSLC

SEQ ID NO: 61117 - protein, 191 aa, Homo sapiens
  Payload ID: 12207
  Gene Symbol: PNLIPRP1
  Gene Name: pancreatic lipase-related protein 1
  ENSP ID: ENSP00000436123
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRIT

SEQ ID NO: 61118 - protein, 185 aa, Homo sapiens
  Payload ID: 12207
  Gene Symbol: PNLIPRP1
  Gene Name: pancreatic lipase-related protein 1
  ENSP ID: ENSP00000437263
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKTEYSYPPSKVHLIGHSLGAHVAGEAGSKTPGLSRITGLDPVEASFESTPEEVRLDPSDADFVDVIHTDAAPLIPF

SEQ ID NO: 61119 - protein, 468 aa, Homo sapiens
  Payload ID: 12208
  Gene Symbol: PNLIPRP2
  Gene Name: pancreatic lipase-related protein 2
  ENSP ID: ENSP00000463502
MLPPWTLGLLLLATVRGKEVCYGQLGCFSDEKPWAGTLQRPVKLLPWSPEDIDTRFLLYTNENPNNFQLITGTEPDTIEASNFQLDRKTRFIIHGFLDKAEDSWPSDMCKKMFEVEKVNCICVDWRHGSRAMYTQAVQNIRVVGAETAFLIQALSTQLGYSLEDVHVIGHSLGAHTAAEAGRRLGGRVGRITGLDPAGPCFQDEPEEVRLDPSDAVFVDVIHTDSSPIVPSLGFGMSQKVGHLDFFPNGGKEMPGCKKNVLSTITDIDGIWEGIGGFVSCNHLRSFEYYSSSVLNPDGFLGYPCASYDEFQESKCFPCPAEGCPKMGHYADQFKGKTSAVEQTFFLNTGESGNFTSRYKISVTLSGKEKVNGYIRIALYGSNENSKQYEIFKGSLKPDASHTCAIDVDFNVGKIQKVKFLWNKRGINLSEPKLGASQITVQSGEDGTEYNFCSSDTVEENVLQSLYPC

SEQ ID NO: 61120 - protein, 469 aa, Homo sapiens
  Payload ID: 12208
  Gene Symbol: PNLIPRP2
  Gene Name: pancreatic lipase-related protein 2
  ENSP ID: ENSP00000468117
MLPPWTLGLLLLATVRGKEVCYGQLGCFSDEKPWAGTLQRPVKLLPWSPEDIDTRFLLYTNENPNNFQLITGTEPDTIEASNFQLDRKTRFIIHGFLDKAEDSWPSDMCKKMFEVEKVNCICVDWRHGSRAMYTQAVQNIRVVGAETAFLIQALSTQLGYSLEDVHVIGHSLGAHTAAEAGRRLGGRVGRITGLDPAGPCFQDEPEEVRLDPSDAVFVDVIHTDSSPIVPSLGFGMSQKVGHLDFFPNGGKEMPGCKKNVLSTITDIDGIWEGIGGFVSCNHLRSFEYYSSSVLNPDGFLGYPCASYDEFQESKCFPCPAEGCPKMGHYADQFKGKTSAVEQTFFLNTGESGNFTSWRYKISVTLSGKEKVNGYIRIALYGSNENSKQYEIFKGSLKPDASHTCAIDVDFNVGKIQKVKFLWNKRGINLSEPKLGASQITVQSGEDGTEYNFCSSDTVEENVLQSLYPC

SEQ ID NO: 61121 - protein, 468 aa, Homo sapiens; identical to SEQ ID NO: 61119
  Payload ID: 12208
  Gene Symbol: PNLIPRP2
  Gene Name: pancreatic lipase-related protein 2
  ENSP ID: ENSP00000480815

SEQ ID NO: 61122 - protein, 467 aa, Homo sapiens
  Payload ID: 12209
  Gene Symbol: PNLIPRP3
  Gene Name: pancreatic lipase-related protein 3
  Uniprot ID: Q17RR3
  ENSP ID: ENSP00000358232
MLGIWIVAFLFFGTSRGKEVCYERLGCFKDGLPWTRTFSTELVGLPWSPEKINTRFLLYTIHNPNAYQEISAVNSSTIQASYFGTDKITRINIAGWKTDGKWQRDMCNVLLQLEDINCINLDWINGSREYIHAVNNLRVVGAEVAYFIDVLMKKFEYSPSKVHLIGHSLGAHLAGEAGSRIPGLGRITGLDPAGPFFHNTPKEVRLDPSDANFVDVIHTNAARILFELGVGTIDACGHLDFYPNGGKHMPGCEDLITPLLKFNFNAYKKEMASFFDCNHARSYQFYAESILNPDAFIAYPCRSYTSFKAGNCFFCSKEGCPTMGHFADRFHFKNMKTNGSHYFLNTGSLSPFARWRHKLSVKLSGSEVTQGTVFLRVGGAVRKTGEFAIVSGKLEPGMTYTKLIDADVNVGNITSVQFIWKKHLFEDSQNKLGAEMVINTSGKYGYKSTFCSQDIMGPNILQNLKPC

SEQ ID NO: 61123 - protein, 95 aa, Homo sapiens
  Payload ID: 12210
  Gene Symbol: PPY
  Gene Name: pancreatic polypeptide
  Uniprot ID: P01298
  ENSP ID: ENSP00000225992
MAAARLCLSLLLLSTCVALLLQPLLGAQGAPLEPVYPGDNATPEQMAQYAADLRRYINMLTRPRYGKRHKEDTLAFSEWGSPHAAVPRELSPLDL

SEQ ID NO: 61124 - protein, 105 aa, Homo sapiens
  Payload ID: 12210
  Gene Symbol: PPY
  Gene Name: pancreatic polypeptide
  ENSP ID: ENSP00000465711
MAAARLCLSLLLLSTCVALLLQPLLGAQGAPLEPVYPGDNATPEQMAQYAADLRRYINMLTRPSACPCCLFPPRYGKRHKEDTLAFSEWGSPHAAVPRELSPLDL

SEQ ID NO: 61125 - protein, 95 aa, Homo sapiens; identical to SEQ ID NO: 61123
  Payload ID: 12210
  Gene Symbol: PPY
  Gene Name: pancreatic polypeptide
  Uniprot ID: P01298
  ENSP ID: ENSP00000466009

SEQ ID NO: 61126 - protein, 79 aa, Homo sapiens
  Payload ID: 12210
  Gene Symbol: PPY
  Gene Name: pancreatic polypeptide
  ENSP ID: ENSP00000466546
MAAARLCLSLLLLSTCVALLLQPLLGAQGAPLEPVYPGDNATPEQMAQYAADLRRYINMLTRPRPRPMCPGQDGAYRQI

SEQ ID NO: 61127 - protein, 132 aa, Homo sapiens
  Payload ID: 12210
  Gene Symbol: PPY
  Gene Name: pancreatic polypeptide
  ENSP ID: ENSP00000489472
  MOD_RES (1)..(1): Any amino acid
XQYAADLRRYINMLTRPRCVPQLGREIPAPGTLGPLHIPGHTLSPAPAPAPSRPALGKTGHLCSTGLDQCALGKMVPTGRYETGGLAPGHSACPCCLFPPRYGKRHKEDTLAFSEWGSPHAAVPRELSPLDL

SEQ ID NO: 61128 - protein, 140 aa, Homo sapiens
  Payload ID: 12211
  Gene Symbol: PPDPF
  Gene Name: pancreatic progenitor cell differentiation and proliferation factor
  ENSP ID: ENSP00000359196
MAAIPSSGSLVATHDYYRRRLGSTSSNSSCSSTECPGEAIPHPPGECRIAPFSPRSSRSWQHQDPTSLLSGLPKADPGHWWASFFFGKSTLPFMATVLESAEHSEPPQASSSMTACGLARDAPRKQPGGQSSTASAGPPS

SEQ ID NO: 61129 - protein, 114 aa, Homo sapiens
  Payload ID: 12211
  Gene Symbol: PPDPF
  Gene Name: pancreatic progenitor cell differentiation and proliferation factor
  Uniprot ID: Q9H3Y8
  ENSP ID: ENSP00000359198
MAAIPSSGSLVATHDYYRRRLGSTSSNSSCSSTECPGEAIPHPPGLPKADPGHWWASFFFGKSTLPFMATVLESAEHSEPPQASSSMTACGLARDAPRKQPGGQSSTASAGPPS

SEQ ID NO: 61130 - protein, 426 aa, Homo sapiens
  Payload ID: 12212
  Gene Symbol: PANX1
  Gene Name: pannexin 1
  Uniprot ID: Q96RD7
  ENSP ID: ENSP00000227638
MAIAQLATEYVFSDFLLKEPTEPKFKGLRLELAVDKMVTCIAVGLPLLLISLAFAQEISIGTQISCFSPSSFSWRQAAFVDSYCWAAVQQKNSLQSESGNLPLWLHKFFPYILLLFAILLYLPPLFWRFAAAPHICSDLKFIMEELDKVYNRAIKAAKSARDLDMRDGACSVPGVTENLGQSLWEVSESHFKYPIVEQYLKTKKNSNNLIIKYISCRLLTLIIILLACIYLGYYFSLSSLSDEFVCSIKSGILRNDSTVPDQFQCKLIAVGIFQLLSVINLVVYVLLAPVVVYTLFVPFRQKTDVLKVYEILPTFDVLHFKSEGYNDLSLYNLFLEENISEVKSYKCLKVLENIKSSGQGIDPMLLLTNLGMIKMDVVDGKTPMSAEMREEQGNQTAELQGMNIDSETKANNGEKNARQRLLDSSC

SEQ ID NO: 61131 - protein, 422 aa, Homo sapiens
  Payload ID: 12212
  Gene Symbol: PANX1
  Gene Name: pannexin 1
  Uniprot ID: Q96RD7
  ENSP ID: ENSP00000411461
MAIAQLATEYVFSDFLLKEPTEPKFKGLRLELAVDKMVTCIAVGLPLLLISLAFAQEISIGTQISCFSPSSFSWRQAAFVDSYCWAAVQQKNSLQSESGNLPLWLHKFFPYILLLFAILLYLPPLFWRFAAAPHICSDLKFIMEELDKVYNRAIKAAKSARDLDMRDGACSVPGVTENLGQSLWEVSESHFKYPIVEQYLKTKKNSNNLIIKYISCRLLTLIIILLACIYLGYYFSLSSLSDEFVCSIKSGILRNDSTVPDQFQCKLIAVGIFQLLSVINLVVYVLLAPVVVYTLFVPFRQKTDVLKVYEILPTFDVLHFKSEGYNDLSLYNLFLEENISEVKSYKCLKVLENIKSSGQGIDPMLLLTNLGMIKMDVVDGKTPMSAEMREEQGNQTAELQDSETKANNGEKNARQRLLDSSC

SEQ ID NO: 61132 - protein, 643 aa, Homo sapiens
  Payload ID: 12213
  Gene Symbol: PANX2
  Gene Name: pannexin 2
  Uniprot ID: Q96RD6
  ENSP ID: ENSP00000159647
MHHLLEQSADMATALLAGEKLRELILPGAQDDKAGALAALLLQLKLELPFDRVVTIGTVLVPILLVTLVFTKNFAEEPIYCYTPHNFTRDQALYARGYCWTELRDALPGVDASLWPSLFEHKFLPYALLAFAAIMYVPALGWEFLASTRLTSELNFLLQEIDNCYHRAAEGRAPKIEKQIQSKGPGITEREKREIIENAEKEKSPEQNLFEKYLERRGRSNFLAKLYLARHVLILLLSAVPISYLCTYYATQKQNEFTCALGASPDGAAGAGPAVRVSCKLPSVQLQRIIAGVDIVLLCVMNLIILVNLIHLFIFRKSNFIFDKLHKVGIKTRRQWRRSQFCDINILAMFCNENRDHIKSLNRLDFITNESDLMYDNVVRQLLAALAQSNHDATPTVRDSGVQTVDPSANPAEPDGAAEPPVVKRPRKKMKWIPTSNPLPQPFKEPLAIMRVENSKAEKPKPARRKTATDTLIAPLLDRSAHHYKGGGGDPGPGPAPAPAPPPAPDKKHARHFSLDVHPYILGTKKAKAEAVPAALPASRSQEGGFLSQAEDCGLGLAPAPIKDAPLPEKEIPYPTEPARAGLPSGGPFHVRSPPAAPAVAPLTPASLGKAEPLTILSRNATHPLLHINTLSSSPPSTSRERS

SEQ ID NO: 61133 - protein, 677 aa, Homo sapiens
  Payload ID: 12213
  Gene Symbol: PANX2
  Gene Name: pannexin 2
  Uniprot ID: Q96RD6
  ENSP ID: ENSP00000379183
MHHLLEQSADMATALLAGEKLRELILPGAQDDKAGALAALLLQLKLELPFDRVVTIGTVLVPILLVTLVFTKNFAEEPIYCYTPHNFTRDQALYARGYCWTELRDALPGVDASLWPSLFEHKFLPYALLAFAAIMYVPALGWEFLASTRLTSELNFLLQEIDNCYHRAAEGRAPKIEKQIQSKGPGITEREKREIIENAEKEKSPEQNLFEKYLERRGRSNFLAKLYLARHVLILLLSAVPISYLCTYYATQKQNEFTCALGASPDGAAGAGPAVRVSCKLPSVQLQRIIAGVDIVLLCVMNLIILVNLIHLFIFRKSNFIFDKLHKVGIKTRRQWRRSQFCDINILAMFCNENRDHIKSLNRLDFITNESDLMYDNVVRQLLAALAQSNHDATPTVRDSGVQTVDPSANPAEPDGAAEPPVVKRPRKKMKWIPTSNPLPQPFKEPLAIMRVENSKAEKPKPARRKTATDTLIAPLLDRSAHHYKGGGGDPGPGPAPAPAPPPAPDKKHARHFSLDVHPYILGTKKAKAEAVPAALPASRSQEGGFLSQAEDCGLGLAPAPIKDAPLPEKEIPYPTEPARAGLPSGGPFHVRSPPAAPAVAPLTPASLGKAEPLTILSRNATHPLLHINTLYEAREEEDGGPRLPQDVGDLIAIPAPQQILIATFDEPRTVVSTVEF

SEQ ID NO: 61134 - protein, 77 aa, Homo sapiens
  Payload ID: 12213
  Gene Symbol: PANX2
  Gene Name: pannexin 2
  ENSP ID: ENSP00000384148
MATALLAGEKLRELILPGAQDDKAGALAALLLQLKLELPFDRVVTIGTVLVPILLVTLVFTKNFAGWTLFSGSWDWL

SEQ ID NO: 61135 - protein, 392 aa, Homo sapiens
  Payload ID: 12214
  Gene Symbol: PANX3
  Gene Name: pannexin 3
  Uniprot ID: Q96QZ0
  ENSP ID: ENSP00000284288
MSLAHTAAEYMLSDALLPDRRGPRLKGLRLELPLDRIVKFVAVGSPLLLMSLAFAQEFSSGSPISCFSPSNFSIRQAAYVDSSCWDSLLHHKQDGPGQDKMKSLWPHKALPYSLLALALLMYLPVLLWQYAAVPALSSDLLFIISELDKSYNRSIRLVQHMLKIRQKSSDPYVFWNELEKARKERYFEFPLLERYLACKQRSHSLVATYLLRNSLLLIFTSATYLYLGHFHLDVFFQEEFSCSIKTGLLSDETHVPNLITCRLTSLSIFQIVSLSSVAIYTILVPVIIYNLTRLCRWDKRLLSVYEMLPAFDLLSRKMLGCPINDLNVILLFLRANISELISFSWLSVLCVLKDTTTQKHNIDTVVDFMTLLAGLEPSKPKHLTNSACDEHP

SEQ ID NO: 61136 - protein, 598 aa, Homo sapiens
  Payload ID: 12215
  Gene Symbol: PANK1
  Gene Name: pantothenate kinase 1
  Uniprot ID: Q8TE04
  ENSP ID: ENSP00000302108
MLKLVGGGGGQDWACSVAGTSLGGEEAAFEVARPGDQGKAGGGSPGWGCAGIPDSAPGAGVLQAGAVGPARGGQGAEEVGESAGGGEERRVRHPQAPALRLLNRKPQGGSGEIKTPENDLQRGRLSRGPRTAPPAPGMGDRSGQQERSVPHSPGAPVGTSAAAVNGLLHNGFHPPPVQPPHVCSRGPVGGSDAAPQRLPLLPELQPQPLLPQHDSPAKKCRLRRRMDSGRKNRPPFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSLGGGTFLGLCCLLTGCETFEEALEMAAKGDSTNVDKLVKDIYGGDYERFGLQGSAVASSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 61137 - protein, 314 aa, Homo sapiens
  Payload ID: 12215
  Gene Symbol: PANK1
  Gene Name: pantothenate kinase 1
  Uniprot ID: Q8TE04
  ENSP ID: ENSP00000318526
MKLINGKKQTFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 61138 - protein, 373 aa, Homo sapiens
  Payload ID: 12215
  Gene Symbol: PANK1
  Gene Name: pantothenate kinase 1
  Uniprot ID: Q8TE04
  ENSP ID: ENSP00000345118
MKLINGKKQTFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSLGGGTFLGLCCLLTGCETFEEALEMAAKGDSTNVDKLVKDIYGGDYERFGLQGSAVASSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 61139 - protein, 570 aa, Homo sapiens
  Payload ID: 12216
  Gene Symbol: PANK2
  Gene Name: pantothenate kinase 2
  Uniprot ID: Q9BZ23
  ENSP ID: ENSP00000313377
MRRLGPFHPRVHWAAPPSLSSGLHRLLFLRGTRIPSSTTLSPPRHDSLSLDGGTVNPPRVREPTGREAFGPSPASSDWLPARWRNGRGGRPRARLCSGWTAAEEARRNPTLGGLLGRQRLLLRMGGGRLGAPMERHGRASATSVSSAGEQAAGDPEGRRQEPLRRRASSASVPAVGASAEGTRRDRLGSYSGPTSVSRQRVESLRKKRPLFPWFGLDIGGTLVKLVYFEPKDITAEEEEEEVESLKSIRKYLTSNVAYGSTGIRDVHLELKDLTLCGRKGNLHFIRFPTHDMPAFIQMGRDKNFSSLHTVFCATGGGAYKFEQDFLTIGDLQLCKLDELDCLIKGILYIDSVGFNGRSQCYYFENPADSEKCQKLPFDLKNPYPLLLVNIGSGVSILAVYSKDNYKRVTGTSLGGGTFFGLCCLLTGCTTFEEALEMASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 61140 - protein, 279 aa, Homo sapiens
  Payload ID: 12216
  Gene Symbol: PANK2
  Gene Name: pantothenate kinase 2
  Uniprot ID: Q9BZ23
  ENSP ID: ENSP00000417609
MPAFIQMGRDKNFSSLHTVFCATGGGAYKFEQDFLTIGDLQLCKLDELDCLIKGILYIDSVGFNGRSQCYYFENPADSEKCQKLPFDLKNPYPLLLVNIGSGVSILAVYSKDNYKRVTGTSLGGGTFFGLCCLLTGCTTFEEALEMASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 61141 - protein, 115 aa, Homo sapiens
  Payload ID: 12216
  Gene Symbol: PANK2
  Gene Name: pantothenate kinase 2
  ENSP ID: ENSP00000476745
MASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFS

SEQ ID NO: 61142 - protein, 158 aa, Homo sapiens
  Payload ID: 12216
  Gene Symbol: PANK2
  Gene Name: pantothenate kinase 2
  ENSP ID: ENSP00000477229
MGGGRLGAPMERHGRASATSVSSAGEQAAGDPEGRRQEPLRRRASSASVPAVGASAEGTRRDRLGSYSGPTSVSRQRVESLRKKRPLFPWFGLDIGGTLVKLVYFEPKDITAEEEEEEVESLKSIRKYLTSNVAYGSTGIRDVHLELKDLTLCGRKDR

SEQ ID NO: 61143 - protein, 447 aa, Homo sapiens
  Payload ID: 12216
  Gene Symbol: PANK2
  Gene Name: pantothenate kinase 2
  Uniprot ID: Q9BZ23
  ENSP ID: ENSP00000477429
MGGGRLGAPMERHGRASATSVSSAGEQAAGDPEGRRQEPLRRRASSASVPAVGASAEGTRRDRLGSYSGPTSVSRQRVESLRKKRPLFPWFGLDIGGTLVKLVYFEPKDITAEEEEEEVESLKSIRKYLTSNVAYGSTGIRDVHLELKDLTLCGRKGNLHFIRFPTHDMPAFIQMGRDKNFSSLHTVFCATGGGAYKFEQDFLTIGDLQLCKLDELDCLIKGILYIDSVGFNGRSQCYYFENPADSEKCQKLPFDLKNPYPLLLVNIGSGVSILAVYSKDNYKRVTGTSLGGGTFFGLCCLLTGCTTFEEALEMASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 61144 - protein, 279 aa, Homo sapiens; identical to SEQ ID NO: 61140
  Payload ID: 12216
  Gene Symbol: PANK2
  Gene Name: pantothenate kinase 2
  Uniprot ID: Q9BZ23
  ENSP ID: ENSP00000481523

SEQ ID NO: 61145 - protein, 370 aa, Homo sapiens
  Payload ID: 12217
  Gene Symbol: PANK3
  Gene Name: pantothenate kinase 3
  Uniprot ID: Q9H999
  ENSP ID: ENSP00000239231
MKIKDAKKPSFPWFGMDIGGTLVKLSYFEPIDITAEEEQEEVESLKSIRKYLTSNVAYGSTGIRDVHLELKDLTLFGRRGNLHFIRFPTQDLPTFIQMGRDKNFSTLQTVLCATGGGAYKFEKDFRTIGNLHLHKLDELDCLVKGLLYIDSVSFNGQAECYYFANASEPERCQKMPFNLDDPYPLLVVNIGSGVSILAVHSKDNYKRVTGTSLGGGTFLGLCSLLTGCESFEEALEMASKGDSTQADKLVRDIYGGDYERFGLPGWAVASSFGNMIYKEKRESVSKEDLARATLVTITNNIGSVARMCAVNEKINRVVFVGNFLRVNTLSMKLLAYALDYWSKGQLKALFLEHEGYFGAVGALLGLPNFS

SEQ ID NO: 61146 - protein, 122 aa, Homo sapiens
  Payload ID: 12217
  Gene Symbol: PANK3
  Gene Name: pantothenate kinase 3
  ENSP ID: ENSP00000428631
MDIGGTLVKLSYFEPIDITAEEEQEEVESLKSIRKYLTSNVAYGSTGIRDVHLELKDLTLFGRRGNLHFIRFPTQDLPTFIQMGRDKNFSTLQTVLCATGGGAYKFEKDFRTIGNLHLHKLD

SEQ ID NO: 61147 - protein, 781 aa, Homo sapiens
  Payload ID: 12218
  Gene Symbol: PANK4
  Gene Name: pantothenate kinase 4
  Uniprot ID: Q9NVE7
  ENSP ID: ENSP00000367727
MSWPGTFKMAECGASGSGSSGDSLDKSITLPPDEIFRNLENAKRFAIDIGGSLTKLAYYSTVQHKVAKVRSFDHSGKDTEREHEPPYEISVQEEITARLHFIKFENTYIEACLDFIKDHLVNTETKVIQATGGGAYKFKDLIEEKLRLKVDKEDVMTCLIKGCNFVLKNIPHEAFVYQKDSDPEFRFQTNHPHIFPYLLVNIGSGVSIVKVETEDRFEWVGGSSIGGGTFWGLGALLTKTKKFDELLHLASRGQHSNVDMLVRDVYGGAHQTLGLSGNLIASSFGKSATADQEFSKEDMAKSLLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKGPPHKCALIFADNSGIDIILGVFPFVRELLLRGTEVILACNSGPALNDVTHSESLIVAERIAGMDPVVHSALQEERLLLVQTGSSSPCLDLSRLDKGLAALVRERGADLVVIEGMGRAVHTNYHAALRCESLKLAVIKNAWLAERLGGRLFSVIFKYEVPAE

SEQ ID NO: 61148 - protein, 737 aa, Homo sapiens
  Payload ID: 12218
  Gene Symbol: PANK4
  Gene Name: pantothenate kinase 4
  ENSP ID: ENSP00000421433
TFKMAECGASGSGSSGDSLDKSITLPPDEIFRNLENAKRFAIDIGGSLTKLAYYSTVQHKVAKVRSFDHSGKDTEREHEPPYEISVQEEITARLHFIKFENTYIEACLDFIKDHLVNTETKVIQATGGGAFVYQKDSDPEFRFQTNHPHIFPYLLVNIGSGVSIVKVETEDRFEWVGGSSIGGGTFWGLGALLTKTKKFDELLHLASRGQHSNVDMLVRDVYGGAHQTLGLSGNLIASSFGKSATADQEFSKEDMAKSLLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKGPPHKCALIFADNSGIDIILGVFPFVRELLLRGTEVILACNSGPALNDVTHSESLIVAERIAGMDPVVHSALQEERLLLVQTGSSSPCLDLSRLDKGLAALVRERGADLVVIEGMGRAVHTNYHAALRCESLKLAVIKNAWLAERLGGRLFSVIFKYEVPAE

SEQ ID NO: 61149 - protein, 136 aa, Homo sapiens
  Payload ID: 12218
  Gene Symbol: PANK4
  Gene Name: pantothenate kinase 4
  ENSP ID: ENSP00000423920
FRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKITVE

SEQ ID NO: 61150 - protein, 41 aa, Homo sapiens
  Payload ID: 12218
  Gene Symbol: PANK4
  Gene Name: pantothenate kinase 4
  ENSP ID: ENSP00000425668
GASGSGSSGDSLDKSITLPPDEIFRNLENAKRFAIDIGHRT

SEQ ID NO: 61151 - protein, 154 aa, Homo sapiens
  Payload ID: 12218
  Gene Symbol: PANK4
  Gene Name: pantothenate kinase 4
  ENSP ID: ENSP00000425674
TFKMAECGASGSGSSGDSLDKSITLPPDEIFRNLENAKRFAIDIGFLSSSSPKPLIYRDFSLQDTQRVWGMDPQAPLCPGPESCPVCVSPAGGSLTKLAYYSTVQHKVAKVRSFDHSGKVSLHCGHPGQGSRFSVVLDLALVSQSSLCCCRPRL

SEQ ID NO: 61152 - protein, 473 aa, Homo sapiens
  Payload ID: 12218
  Gene Symbol: PANK4
  Gene Name: pantothenate kinase 4
  ENSP ID: ENSP00000425932
  MOD_RES (1)..(1): Any amino acid
XKEDVMTCLIKGCNFVLKNIPHEAFVYQKDSDPEFRFQTNHPHIFPYLLVNIGSGVSIVKVETEDRFEWVGGSSIGGGTFWGLGALLTKTKKFDELLHLASRGQHSNVDMLVRDVYGGAHQTLGLSGNLIASSFGKSATADQEFSKEDMAKSLLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKITVE

SEQ ID NO: 61153 - protein, 190 aa, Homo sapiens
  Payload ID: 12218
  Gene Symbol: PANK4
  Gene Name: pantothenate kinase 4
  ENSP ID: ENSP00000425977
LLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGAKIPLLATWWVSEDVASARHVASKGS

SEQ ID NO: 61154 - protein, 773 aa, Homo sapiens
  Payload ID: 12218
  Gene Symbol: PANK4
  Gene Name: pantothenate kinase 4
  Uniprot ID: Q9NVE7
  ENSP ID: ENSP00000478189
MAECGASGSGSSGDSLDKSITLPPDEIFRNLENAKRFAIDIGGSLTKLAYYSTVQHKVAKVRSFDHSGKDTEREHEPPYEISVQEEITARLHFIKFENTYIEACLDFIKDHLVNTETKVIQATGGGAYKFKDLIEEKLRLKVDKEDVMTCLIKGCNFVLKNIPHEAFVYQKDSDPEFRFQTNHPHIFPYLLVNIGSGVSIVKVETEDRFEWVGGSSIGGGTFWGLGALLTKTKKFDELLHLASRGQHSNVDMLVRDVYGGAHQTLGLSGNLIASSFGKSATADQEFSKEDMAKSLLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKGPPHKCALIFADNSGIDIILGVFPFVRELLLRGTEVILACNSGPALNDVTHSESLIVAERIAGMDPVVHSALQEERLLLVQTGSSSPCLDLSRLDKGLAALVRERGADLVVIEGMGRAVHTNYHAALRCESLKLAVIKNAWLAERLGGRLFSVIFKYEVPAE

SEQ ID NO: 61155 - protein, 151 aa, Homo sapiens
  Payload ID: 12218
  Gene Symbol: PANK4
  Gene Name: pantothenate kinase 4
  ENSP ID: ENSP00000486126
MAECGASGSGSSGDSLDKSITLPPDEIFRNLENAKRFAIDIGFLSSSSPKPLIYRDFSLQDTQRVWGMDPQAPLCPGPESCPVCVSPAGGSLTKLAYYSTVQHKVAKVRSFDHSGKVSLHCGHPGQGSRFSVVLDLALVSQSSLCCCRPRL

SEQ ID NO: 61156 - protein, 136 aa, Homo sapiens; identical to SEQ ID NO: 61149
  Payload ID: 12218
  Gene Symbol: PANK4
  Gene Name: pantothenate kinase 4
  ENSP ID: ENSP00000486272

SEQ ID NO: 61157 - protein, 734 aa, Homo sapiens
  Payload ID: 12218
  Gene Symbol: PANK4
  Gene Name: pantothenate kinase 4
  ENSP ID: ENSP00000486414
MAECGASGSGSSGDSLDKSITLPPDEIFRNLENAKRFAIDIGGSLTKLAYYSTVQHKVAKVRSFDHSGKDTEREHEPPYEISVQEEITARLHFIKFENTYIEACLDFIKDHLVNTETKVIQATGGGAFVYQKDSDPEFRFQTNHPHIFPYLLVNIGSGVSIVKVETEDRFEWVGGSSIGGGTFWGLGALLTKTKKFDELLHLASRGQHSNVDMLVRDVYGGAHQTLGLSGNLIASSFGKSATADQEFSKEDMAKSLLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKGPPHKCALIFADNSGIDIILGVFPFVRELLLRGTEVILACNSGPALNDVTHSESLIVAERIAGMDPVVHSALQEERLLLVQTGSSSPCLDLSRLDKGLAALVRERGADLVVIEGMGRAVHTNYHAALRCESLKLAVIKNAWLAERLGGRLFSVIFKYEVPAE

SEQ ID NO: 61158 - protein, 473 aa, Homo sapiens; identical to SEQ ID NO: 61152
  Payload ID: 12218
  Gene Symbol: PANK4
  Gene Name: pantothenate kinase 4
  ENSP ID: ENSP00000486638
  MOD_RES (1)..(1): Any amino acid

SEQ ID NO: 61159 - protein, 41 aa, Homo sapiens; identical to SEQ ID NO: 61150
  Payload ID: 12218
  Gene Symbol: PANK4
  Gene Name: pantothenate kinase 4
  ENSP ID: ENSP00000487314

SEQ ID NO: 61160 - protein, 190 aa, Homo sapiens; identical to SEQ ID NO: 61153
  Payload ID: 12218
  Gene Symbol: PANK4
  Gene Name: pantothenate kinase 4
  ENSP ID: ENSP00000487332

SEQ ID NO: 61161 - protein, 484 aa, Homo sapiens
  Payload ID: 12219
  Gene Symbol: PAPD4
  Gene Name: PAP associated domain containing 4
  Uniprot ID: Q6PIY7
  ENSP ID: ENSP00000296783
MFPNSILGRPPFTPNHQQHNNFFTLSPTVYSHQQLIDAQFNFQNADLSRAVSLQQLTYGNVSPIQTSASPLFRGRKRLSDEKNLPLDGKRQRFHSPHQEPTVVNQIVPLSGERRYSMPPLFHTHYVPDIVRCVPPFREIAFLEPREITLPEAKDKLSQQILELFETCQQQISDLKKKELCRTQLQREIQLLFPQSRLFLVGSSLNGFGTRSSDGDLCLVVKEEPCFFQVNQKTEARHILTLVHKHFCTRLSGYIERPQLIRAKVPIVKFRDKVSCVEFDLNVNNIVGIRNTFLLRTYAYLENRVRPLVLVIKKWASHHQINDASRGTLSSYSLVLMVLHYLQTLPEPILPSLQKIYPESFSPAIQLHLVHQAPCNVPPYLSKNESNLGDLLLGFLKYYATEFDWNSQMISVREAKAIPRPDGIEWRNKYICVEEPFDGTNTARAVHEKQKFDMIKDQFLKSWHRLKNKRDLNSILPVRAAVLKR

SEQ ID NO: 61162 - protein, 480 aa, Homo sapiens
  Payload ID: 12219
  Gene Symbol: PAPD4
  Gene Name: PAP associated domain containing 4
  Uniprot ID: Q6PIY7
  ENSP ID: ENSP00000393412
MFPNSILGRPPFTPNHQQHNNFFTLSPTVYSHQQLIDAQFNFQNADLSRAVSLQQLTYGNVSPIQTSASPLFRGRKRLSDEKNLPLDGKRQRFHSPHQEPTVVNQIVPLSGERRYSMPPLFHTHYVPDIVRCVPPFREIAFLEPREITLPEAKDKLSQQILELFETCQQQISDLKKKELCRTQLQREIQLLFPQSRLFLVGSSLNGFGTRSSDGDLCLVVKEEPVNQKTEARHILTLVHKHFCTRLSGYIERPQLIRAKVPIVKFRDKVSCVEFDLNVNNIVGIRNTFLLRTYAYLENRVRPLVLVIKKWASHHQINDASRGTLSSYSLVLMVLHYLQTLPEPILPSLQKIYPESFSPAIQLHLVHQAPCNVPPYLSKNESNLGDLLLGFLKYYATEFDWNSQMISVREAKAIPRPDGIEWRNKYICVEEPFDGTNTARAVHEKQKFDMIKDQFLKSWHRLKNKRDLNSILPVRAAVLKR

SEQ ID NO: 61163 - protein, 484 aa, Homo sapiens; identical to SEQ ID NO: 61161
  Payload ID: 12219
  Gene Symbol: PAPD4
  Gene Name: PAP associated domain containing 4
  Uniprot ID: Q6PIY7
  ENSP ID: ENSP00000396861

SEQ ID NO: 61164 - protein, 484 aa, Homo sapiens; identical to SEQ ID NO: 61161
  Payload ID: 12219
  Gene Symbol: PAPD4
  Gene Name: PAP associated domain containing 4
  Uniprot ID: Q6PIY7
  ENSP ID: ENSP00000397563

SEQ ID NO: 61165 - protein, 441 aa, Homo sapiens
  Payload ID: 12219
  Gene Symbol: PAPD4
  Gene Name: PAP associated domain containing 4
  ENSP ID: ENSP00000421966
MFPNSILGRPPFTPNHQQHNNFFTLSPTVYSHQQLIDAQFNFQNADLSRAVSLQQLTYGNVSPIQTSASPLFRGRKRLSDEKNLPLDGKRQRFHSPHQEPTVVNQIVPLSGERRYSMPPLFHTHYVPDIVRCVPPFREIAFLEPREITLPEAKDKLSQQILELFETCQQQISDLKKKELCRTQLQREIQLLFPQSRLFLVGSSLNGFGTRSSDGDLCLVVKEEPCFFQVNQKTEARHILTLVHKHFCTRLSGYIERPQLIRAKVPIVKFRDKVSCVEFDLNVNNIVGIRNTFLLRTYAYPLPEPILPSLQKIYPESFSPAIQLHLVHQAPCNVPPYLSKNESNLGDLLLGFLKYYATEFDWNSQMISVREAKAIPRPDGIEWRNKYICVEEPFDGTNTARAVHEKQKFDMIKDQFLKSWHRLKNKRDLNSILPVRAAVLKR

SEQ ID NO: 61166 - protein, 303 aa, Homo sapiens
  Payload ID: 12220
  Gene Symbol: PAPD5
  Gene Name: PAP associated domain containing 5
  ENSP ID: ENSP00000350054
  MOD_RES (1)..(1): Any amino acid
XIFGSFKTGLYLPTSDIDLVVFGKWENLPLWTLEEALRKHKVADEDSVKVLDKATVPIIKLTDSFTEVKVDISFNVQNGVRAADLIKDFTKKYPVLPYLVLVLKQFLLQRDLNEVFTGGIGSYSLFLMAVSFLQLHPREDACIPNTNYGVLLIEFFELYGRHFNYLKTGIRIKDGGSYVAKDEVQKNMLDGYRPSMLYIEDPLQPGNDVGRSSYGAMQVKQAFDYAYVVLSHAVSPIAKYYPNNETESILGRIIRVTDEVATYRDWISKQWGLKNRPEPSCNGKIFSLVQCRPLLPHSPALVM

SEQ ID NO: 61167 - protein, 698 aa, Homo sapiens
  Payload ID: 12220
  Gene Symbol: PAPD5
  Gene Name: PAP associated domain containing 5
  Uniprot ID: Q8NDF8
  ENSP ID: ENSP00000396995
MRPRPRSAPGKPRRRSRARLRSSRTPSGGASGGGGSSSSSSTATGGSGSSTGSPGGAASAPAPAPAGMYRSGERLLGSHALPAEQRDFLPLETTNNNNNHHQPGAWARRAGSSASSPPSASSSPHPSAAVPAADPADSASGSSNKRKRDNKASTYGLNYSLLQPSGGRAAGGGRADGGGVVYSGTPWKRRNYNQGVVGLHEEISDFYEYMSPRPEEEKMRMEVVNRIESVIKELWPSADVQIFGSFKTGLYLPTSDIDLVVFGKWENLPLWTLEEALRKHKVADEDSVKVLDKATVPIIKLTDSFTEVKVDISFNVQNGVRAADLIKDFTKKYPVLPYLVLVLKQFLLQRDLNEVFTGGIGSYSLFLMAVSFLQLHPREDACIPNTNYGVLLIEFFELYGRHFNYLKTGIRIKDGGSYVAKDEVQKNMLDGYRPSMLYIEDPLQPGNDVGRSSYGAMQVKQAFDYAYVVLSHAVSPIAKYYPNNETESILGRIIRVTDEVATYRDWISKQWGLKNRPEPSCNGNGVTLIVDTQQLDKCNNNLSEENEALGKCRSKTSESLSKHSSNSSSGPVSSSSATQSSSSDVDSDATPCKTPKQLLCRPSTGNRVGSQDVSLESSQAVGKMQSTQTTNTSNSTNKSQHGSARLFRSSSKGFQGTTQTSHGSLMTNKQHQGKSNNQYYHGKKRKHKRDAPLSDLCR

SEQ ID NO: 61168 - protein, 588 aa, Homo sapiens
  Payload ID: 12220
  Gene Symbol: PAPD5
  Gene Name: PAP associated domain containing 5
  ENSP ID: ENSP00000455837
MYRSGERLLGSHALPAEQRDFLPLETTNNNNNHHQPGAWARRAGSSASSPPSASSSPHPSAAVPAADPADSASGSSNKRKRDNKASTYGLNYSLLQPSGGRAAGGGRADGGGVVYSGTPWKRRNYNQGVVGLHEEISDFYEYMSPRPEEEKMRMEVVNRIESVIKELWPSADVQIFGSFKTGLYLPTSDIDLVVFGKWENLPLWTLEEALRKHKVADEDSVKVLDKATVPIIKLTDSFTEVKVDISFNVQNGVRAADLIKDFTKLHPREDACIPNTNYGVLLIEFFELYGRHFNYLKTGIRIKDGGSYVAKDEVQKNMLDGYRPSMLYIEDPLQPGNDVGRSSYGAMQVKQAFDYAYVVLSHAVSPIAKYYPNNETESILGRIIRVTDEVATYRDWISKQWGLKNRPEPSCNGNGVTLIVDTQQLDKCNNNLSEENEALGKCRSKTSESLSKHSSNSSSGPVSSSSATQSSSSDVDSDATPCKTPKQLLCRPSTGNRVGSQDVSLESSQAVGKMQSTQTTNTSNSTNKSQHGSARLFRSSSKGFQGTTQTSHGSLMTNKQHQGKSNNQYYHGKKRKHKRDAPLSDLCR

SEQ ID NO: 61169 - protein, 792 aa, Homo sapiens
  Payload ID: 12221
  Gene Symbol: PAPD7
  Gene Name: PAP associated domain containing 7
  Uniprot ID: Q5XG87
  ENSP ID: ENSP00000230859
MDPRVAWIQPEQKGPANALWMQIWETSQGVGRGGSGFASYFCLNSPALDTAAAAGAAGRGSGGLGPALPAASPPPPGPTAPAALPPALLTALGPAAEGARRLHKSPSLSSSSSSSSSNAESGTESPGCSSSSSSSASLGRPGGGRGGAFFNFADGAPSAPGTANGHPGPRGPAPAGSPSQHQFHPGRRKRENKASTYGLNYLLSGSRAAALSGGGGPGAQAPRPGTPWKSRAYSPGIQGLHEEIIDFYNFMSPCPEEAAMRREVVKRIETVVKDLWPTADVQIFGSFSTGLYLPTSDIDLVVFGKWERPPLQLLEQALRKHNVAEPCSIKVLDKATVPIIKLTDQETEVKVDISFNMETGVRAAEFIKNYMKKYSLLPYLILVLKQFLLQRDLNEVFTGGISSYSLILMAISFLQLHPRIDARRADENLGMLLVEFFELYGRNFNYLKTGIRIKEGGAYIAKEEIMKAMTSGYRPSMLCIEDPLLPGNDVGRSSYGAMQVKQVFDYAYIVLSHAVSPLARSYPNRDAESTLGRIIKVTQEVIDYRRWIKEKWGSKAHPSPGMDSRIKIKERIATCNGEQTQNREPESPYGQRLTLSLSSPQLLSSGSSASSVSSLSGSDVDSDTPPCTTPSVYQFSLQAPAPLMAGLPTALPMPSGKPQPTTSRTLIMTTNNQTRFTIPPPTLGVAPVPCRQAGVEGTASLKAVHHMSSPAIPSASPNPLSSPHLYHKQHNGMKLSMKGSHGHTQGGGYSSVGSGGVRPPVGNRGHHQYNRTGWRRKKHTHTRDSLPVSLSR

SEQ ID NO: 61170 - protein, 27 aa, Homo sapiens
  Payload ID: 12221
  Gene Symbol: PAPD7
  Gene Name: PAP associated domain containing 7
  ENSP ID: ENSP00000427232
MSPCPEEAAMRREVVKRIETVVKDLWP

SEQ ID NO: 61171 - protein, 542 aa, Homo sapiens
  Payload ID: 12221
  Gene Symbol: PAPD7
  Gene Name: PAP associated domain containing 7
  Uniprot ID: Q5XG87
  ENSP ID: ENSP00000488642
MSPCPEEAAMRREVVKRIETVVKDLWPTADVQIFGSFSTGLYLPTSDIDLVVFGKWERPPLQLLEQALRKHNVAEPCSIKVLDKATVPIIKLTDQETEVKVDISFNMETGVRAAEFIKNYMKKYSLLPYLILVLKQFLLQRDLNEVFTGGISSYSLILMAISFLQLHPRIDARRADENLGMLLVEFFELYGRNFNYLKTGIRIKEGGAYIAKEEIMKAMTSGYRPSMLCIEDPLLPGNDVGRSSYGAMQVKQVFDYAYIVLSHAVSPLARSYPNRDAESTLGRIIKVTQEVIDYRRWIKEKWGSKAHPSPGMDSRIKIKERIATCNGEQTQNREPESPYGQRLTLSLSSPQLLSSGSSASSVSSLSGSDVDSDTPPCTTPSVYQFSLQAPAPLMAGLPTALPMPSGKPQPTTSRTLIMTTNNQTRFTIPPPTLGVAPVPCRQAGVEGTASLKAVHHMSSPAIPSASPNPLSSPHLYHKQHNGMKLSMKGSHGHTQGGGYSSVGSGGVRPPVGNRGHHQYNRTGWRRKKHTHTRDSLPVSLSR

SEQ ID NO: 61172 - protein, 808 aa, Homo sapiens
  Payload ID: 12222
  Gene Symbol: PAPLN
  Gene Name: papilin, proteoglycan-like sulfated glycoprotein
  ENSP ID: ENSP00000216658
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRGYNQILIVPMGATSILIDEAAASRNFLAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHGLAWQVWSPRWCRQPWGSWCGSPAQTTLPRNPRLPGRKMASPSPLTGVCDGPPTSSDRCV

SEQ ID NO: 61173 - protein, 1251 aa, Homo sapiens
  Payload ID: 12222
  Gene Symbol: PAPLN
  Gene Name: papilin, proteoglycan-like sulfated glycoprotein
  Uniprot ID: O95428
  ENSP ID: ENSP00000345395
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHAYPVRCLLPSAHGSCADWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPRHQLQPDGSLVISRVAVEDGGFYTCVAFNGQDRDQRWVQLRVLGELTISGLPPTVTVPEGDTARLLCVVAGESVNIRWSRNGLPVQADGHRVHQSPDGTLLIYNLRARDEGSYTCSAYQGSQAVSRSTEVKVVSPAPTAQPRDPGRDCVDQPELANCDLILQAQLCGNEYYSSFCCASCSRFQPHAQPIWQ

SEQ ID NO: 61174 - protein, 214 aa, Homo sapiens
  Payload ID: 12222
  Gene Symbol: PAPLN
  Gene Name: papilin, proteoglycan-like sulfated glycoprotein
  ENSP ID: ENSP00000451053
VHNTHQPQAQQNEPSECRGSQFGCCYDNVATAAGPLGEGCVGQPSHAYPVRCLLPSAHGSCADWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRSHFPPLQD

SEQ ID NO: 61175 - protein, 1262 aa, Homo sapiens
  Payload ID: 12222
  Gene Symbol: PAPLN
  Gene Name: papilin, proteoglycan-like sulfated glycoprotein
  Uniprot ID: O95428
  ENSP ID: ENSP00000451729
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRGYNQILIVPMGATSILIDEAAASRNFLAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHDWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPRHQLQPDGSLVISRVAVEDGGFYTCVAFNGQDRDQRWVQLRVLGELTISGLPPTVTVPEGDTARLLCVVAGESVNIRWSRNGLPVQADGHRVHQSPDGTLLIYNLRARDEGSYTCSAYQGSQAVSRSTEVKVVSPAPTAQPRDPGRDCVDQPELANCDLILQAQLCGNEYYSSFCCASCSRFQPHAQPIWQ

SEQ ID NO: 61176 - protein, 1278 aa, Homo sapiens
  Payload ID: 12222
  Gene Symbol: PAPLN
  Gene Name: papilin, proteoglycan-like sulfated glycoprotein
  Uniprot ID: O95428
  ENSP ID: ENSP00000451803
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRGYNQILIVPMGATSILIDEAAASRNFLAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHAYPVRCLLPSAHGSCADWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPRHQLQPDGSLVISRVAVEDGGFYTCVAFNGQDRDQRWVQLRVLGELTISGLPPTVTVPEGDTARLLCVVAGESVNIRWSRNGLPVQADGHRVHQSPDGTLLIYNLRARDEGSYTCSAYQGSQAVSRSTEVKVVSPAPTAQPRDPGRDCVDQPELANCDLILQAQLCGNEYYSSFCCASCSRFQPHAQPIWQ

SEQ ID NO: 61177 - protein, 929 aa, Homo sapiens
  Payload ID: 12222
  Gene Symbol: PAPLN
  Gene Name: papilin, proteoglycan-like sulfated glycoprotein
  ENSP ID: ENSP00000452455
MRLLLLVPLLLAPAPGSSAPKVRRQSDTWGPWSQWSPCSRTCGGGVSFRERPCYSQRRDGGSSCVGPARSHRSCRTESCPDGARDFRAEQCAEFDGAEFQGRRYRWLPYYSAPNKCELNCIPKGENFYYKHREAVVDGTPCEPGKRDVCVDGSCRVVGCDHELDSSKQEDKCLRCGGDGTTCYPVAGTFDANDLSRAVKNVRGEYYLNGHWTIEAARALPAASTILHYERGAEGDLAPERLHARGPTSEPLVIELISQEPNPGVHYEYHLPLRRPSPGFSWSHGSWSDCSAECGGGHQSRLVFCTIDHEAYPDHMCQRQPRPADRRSCNLHPCPETKRWKAGPWAPCSASCGGGSQSRSVYCISSDGAGIQEAVEEAECAGLPGKPPAIQACNLQRCAAWSPEPWGECSVSCGVGVRKRSVTCRGERGSLLHTAACSLEDRPPLTEPCVHEDCPLLSDQAWHVGTWGLCSKSCSSGTRRRQVICAIGPPSHCGSLQHSKPVDVEPCNTQPCHLPQEVPSMQDVHTPASNPWMPLGPQESPASDSRGQWWAAQEHPSARGDHRGERGDPRGDQGTHLSALGPAPSLQQPPYQQPLRSGSGPHDCRHSPHGCCPDGHTASLGPQWQGCPGAPCQQSRYGCCPDRVSVAEGPHHAGCTKSYGGDSTGGMPRSRAVASTVHNTHQPQAQQNEPSECRGSQFGCCYDNVATAAGPLGEGCVGQPSHAYPVRCLLPSAHGSCADWAARWYFVASVGQCNRFWYGGCHGNANNFASEQECMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRFT

SEQ ID NO: 61178 - protein, 311 aa, Homo sapiens
  Payload ID: 12222
  Gene Symbol: PAPLN
  Gene Name: papilin, proteoglycan-like sulfated glycoprotein
  ENSP ID: ENSP00000453664
  MOD_RES (1)..(1): Any amino acid
XCMSSCQGSLHGPRRPQPGASGRSTHTDGGGSSPAGEQEPSQHRTGAAVQRKPWPSGGLWRQDQQPGPGEAPHTQAFGEWPWGQELGSRAPGLGGDAGSPAPPFHSSSYRISLAGVEPSLVQAALGQLVRLSCSDDTAPESQAAWQKDGQPISSDRHRLQFDGSLIIHPLQAEDAGTYSCGSTRPGRDSQKIQLRIIGGDMAVLSEAELSRFPQPRDPAQDFGQAGAAGPLGAIPSSHPQPANRLRLDQNQPRVVDASPGQRIRMTCRAEGFPPPAIEWQRDGQPVSSPSTHRPAQGPWQGLRRPARAGQL

SEQ ID NO: 61179 - protein, 491 aa, Homo sapiens
  Payload ID: 12223
  Gene Symbol: PRCC
  Gene Name: papillary renal cell carcinoma (translocation-associated)
  Uniprot ID: Q92733
  ENSP ID: ENSP00000271526
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQDYYSGGYYPAQDPALVPPQEIAPDASFIDDEAFKRLQGKRNRGREEINFVEIKGDDQLSGAQQWMTKSLTEEKTMKSFSKKKGEQPTGQQRRKHQITYLIHQAKERELELKNTWSENKLSRRQTQAKYGF

SEQ ID NO: 61180 - protein, 257 aa, Homo sapiens
  Payload ID: 12223
  Gene Symbol: PRCC
  Gene Name: papillary renal cell carcinoma (translocation-associated)
  ENSP ID: ENSP00000403560
  MOD_RES (1)..(1): Any amino acid
XDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQGLQQHLGHSPLRGIMRFLNSKSGKRTCFVPSFDYYSGGYYPAQDPALVPPQEIAPDASFIDDEAFKRLQGKRNRGREEINFVEIKGDDQLSGAQQWMTKSLTEEKTMKSFSKKKGEQPTGQQRRKHQITYLIHQAKERELELKNTWSENKLSRRQTQAKYGF

SEQ ID NO: 61181 - protein, 198 aa, Homo sapiens
  Payload ID: 12223
  Gene Symbol: PRCC
  Gene Name: papillary renal cell carcinoma (translocation-associated)
  ENSP ID: ENSP00000434762
QEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQFKRLQGKRNRGREEINFVEIKGDDQLSGAQQWMTKSLTEEKTMKSFSKKKGEQPTGQQRRKHQITYLIHQAKERELELKNTWSENKLSRRQTQAKYGF

SEQ ID NO: 61182 - protein, 827 aa, Homo sapiens
  Payload ID: 12224
  Gene Symbol: PAPPA2
  Gene Name: pappalysin 2
  Uniprot ID: Q9BXP8
  ENSP ID: ENSP00000356633
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTGITTVLFCFLLRIHGGL

SEQ ID NO: 61183 - protein, 1791 aa, Homo sapiens
  Payload ID: 12224
  Gene Symbol: PAPPA2
  Gene Name: pappalysin 2
  Uniprot ID: Q9BXP8
  ENSP ID: ENSP00000356634
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTDDNCTDNFTPNQVARMHCYLDLVYQQWTESRKPTPIPIPPMVIGQTNKSLTIHWLPPISGVVYDRASGSLCGACTEDGTFRQYVHTASSRRVCDSSGYWTPEEAVGPPDVDQPCEPSLQAWSPEVHLYHMNMTVPCPTEGCSLELLFQHPVQADTLTLWVTSFFMESSQVLFDTEILLENKESVHLGPLDTFCDIPLTIKLHVDGKVSGVKVYTFDERIEIDAALLTSQPHSPLCSGCRPVRYQVLRDPPFASGLPVVVTHSHRKFTDVEVTPGQMYQYQVLAEAGGELGEASPPLNHIHGAPYCGDGKVSERLGEECDDGDLVSGDGCSKVCELEEGFNCVGEPSLCYMYEGDGICEPFERKTSIVDCGIYTPKGYLDQWATRAYSSHEDKKKCPVSLVTGEPHSLICTSYHPDLPNHRPLTGWFPCVASENETQDDRSEQPEGSLKKEDEVWLKVCFNRPGEARAIFIFLTTDGLVPGEHQQPTVTLYLTDVRGSNHSLGTYGLSCQHNPLIINVTHHQNVLFHHTTSVLLNFSSPRVGISAVALRTSSRIGLSAPSNCISEDEGQNHQGQSCIHRPCGKQDSCPSLLLDHADVVNCTSIGPGLMKCAITCQRGFALQASSGQYIRPMQKEILLTCSSGHWDQNVSCLPVDCGVPDPSLVNYANFSCSEGTKFLKRCSISCVPPAKLQGLSPWLTCLEDGLWSLPEVYCKLECDAPPIILNANLLLPHCLQDNHDVGTICKYECKPGYYVAESAEGKVRNKLLKIQCLEGGIWEQGSCIPVVCEPPPPVFEGMYECTNGFSLDSQCVLNCNQEREKLPILCTKEGLWTQEFKLCENLQGECPPPPSELNSVEYKCEQGYGIGAVCSPLCVIPPSDPVMLPENITADTLEHWMEPVKVQSIVCTGRRQWHPDPVLVHCIQSCEPFQADGWCDTINNRAYCHYDGGDCCSSTLSSKKVIPFAADCDLDECTCRDPKAEENQ

SEQ ID NO: 61184 - protein, 1310 aa, Homo sapiens
  Payload ID: 12225
  Gene Symbol: PARD3
  Gene Name: par-3 family cell polarity regulator
  Uniprot ID: Q8TEW0
  ENSP ID: ENSP00000311986
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 61185 - protein, 1319 aa, Homo sapiens
  Payload ID: 12225
  Gene Symbol: PARD3
  Gene Name: par-3 family cell polarity regulator
  Uniprot ID: Q8TEW0
  ENSP ID: ENSP00000340591
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGESGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 61186 - protein, 1031 aa, Homo sapiens
  Payload ID: 12225
  Gene Symbol: PARD3
  Gene Name: par-3 family cell polarity regulator
  Uniprot ID: Q8TEW0
  ENSP ID: ENSP00000341844
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFSLAKLKPEKR

SEQ ID NO: 61187 - protein, 179 aa, Homo sapiens
  Payload ID: 12225
  Gene Symbol: PARD3
  Gene Name: par-3 family cell polarity regulator
  ENSP ID: ENSP00000363900
MQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGT

SEQ ID NO: 61188 - protein, 1001 aa, Homo sapiens
  Payload ID: 12225
  Gene Symbol: PARD3
  Gene Name: par-3 family cell polarity regulator
  ENSP ID: ENSP00000363905
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFSLAKLKPEKR

SEQ ID NO: 61189 - protein, 988 aa, Homo sapiens
  Payload ID: 12225
  Gene Symbol: PARD3
  Gene Name: par-3 family cell polarity regulator
  Uniprot ID: Q8TEW0
  ENSP ID: ENSP00000363908
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFSLAKLKPEKR

SEQ ID NO: 61190 - protein, 1353 aa, Homo sapiens
  Payload ID: 12225
  Gene Symbol: PARD3
  Gene Name: par-3 family cell polarity regulator
  Uniprot ID: Q8TEW0
  ENSP ID: ENSP00000363920
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 61191 - protein, 1356 aa, Homo sapiens
  Payload ID: 12225
  Gene Symbol: PARD3
  Gene Name: par-3 family cell polarity regulator
  Uniprot ID: Q8TEW0
  ENSP ID: ENSP00000363921
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGESGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 61192 - protein, 1296 aa, Homo sapiens
  Payload ID: 12225
  Gene Symbol: PARD3
  Gene Name: par-3 family cell polarity regulator
  ENSP ID: ENSP00000363922
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 61193 - protein, 1244 aa, Homo sapiens
  Payload ID: 12225
  Gene Symbol: PARD3
  Gene Name: par-3 family cell polarity regulator
  Uniprot ID: Q8TEW0
  ENSP ID: ENSP00000363926
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGSSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 61194 - protein, 1266 aa, Homo sapiens
  Payload ID: 12225
  Gene Symbol: PARD3
  Gene Name: par-3 family cell polarity regulator
  Uniprot ID: Q8TEW0
  ENSP ID: ENSP00000440857
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 61195 - protein, 1340 aa, Homo sapiens
  Payload ID: 12225
  Gene Symbol: PARD3
  Gene Name: par-3 family cell polarity regulator
  Uniprot ID: Q8TEW0
  ENSP ID: ENSP00000443147
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 61196 - protein, 747 aa, Homo sapiens
  Payload ID: 12225
  Gene Symbol: PARD3
  Gene Name: par-3 family cell polarity regulator
  ENSP ID: ENSP00000444429
MVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLVADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFSLAKLKPEKR

SEQ ID NO: 61197 - protein, 1136 aa, Homo sapiens
  Payload ID: 12226
  Gene Symbol: PARD3B
  Gene Name: par-3 family cell polarity regulator beta
  Uniprot ID: Q8TEW8
  ENSP ID: ENSP00000317261
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSDGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 61198 - protein, 1104 aa, Homo sapiens
  Payload ID: 12226
  Gene Symbol: PARD3B
  Gene Name: par-3 family cell polarity regulator beta
  Uniprot ID: Q8TEW8
  ENSP ID: ENSP00000340280
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERESGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 61199 - protein, 1143 aa, Homo sapiens
  Payload ID: 12226
  Gene Symbol: PARD3B
  Gene Name: par-3 family cell polarity regulator beta
  Uniprot ID: Q8TEW8
  ENSP ID: ENSP00000351618
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 61200 - protein, 1205 aa, Homo sapiens
  Payload ID: 12226
  Gene Symbol: PARD3B
  Gene Name: par-3 family cell polarity regulator beta
  Uniprot ID: Q8TEW8
  ENSP ID: ENSP00000385848
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 61201 - protein, 79 aa, Homo sapiens
  Payload ID: 12226
  Gene Symbol: PARD3B
  Gene Name: par-3 family cell polarity regulator beta
  Uniprot ID: Q8TEW8
  ENSP ID: ENSP00000407718
MKVTVCFGRTGIVVPCKEGQLRVGELTQQALQRYLKTREKVSAARRSGARLQPRHLPGSWLLGEDSSLRIYRWRNPGSR

SEQ ID NO: 61202 - protein, 935 aa, Homo sapiens
  Payload ID: 12226
  Gene Symbol: PARD3B
  Gene Name: par-3 family cell polarity regulator beta
  ENSP ID: ENSP00000473503
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRYGPALKAKLVLILSLLKKAHAFPRLQPNAYGSQFCARSLSAEAEELFGESYSDDRTLS

SEQ ID NO: 61203 - protein, 1062 aa, Homo sapiens
  Payload ID: 12226
  Gene Symbol: PARD3B
  Gene Name: par-3 family cell polarity regulator beta
  ENSP ID: ENSP00000481918
LIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSDGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 61204 - protein, 1030 aa, Homo sapiens
  Payload ID: 12226
  Gene Symbol: PARD3B
  Gene Name: par-3 family cell polarity regulator beta
  ENSP ID: ENSP00000482649
LIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERESGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 61205 - protein, 1069 aa, Homo sapiens
  Payload ID: 12226
  Gene Symbol: PARD3B
  Gene Name: par-3 family cell polarity regulator beta
  ENSP ID: ENSP00000484434
LIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 61206 - protein, 346 aa, Homo sapiens
  Payload ID: 12227
  Gene Symbol: PARD6A
  Gene Name: par-6 family cell polarity regulator alpha
  Uniprot ID: Q9NPB6
  ENSP ID: ENSP00000219255
MARPQRTPARSPDSIVEVKSKFDAEFRRFALPRASVSGFQEFSRLLRAVHQIPGLDVLLGYTDAHGDLLPLTNDDSLHRALASGPPPLRLLVQKRAEADSSGLAFASNSLQRRKKGLLLRPVAPLRTRPPLLISLPQDFRQVSSVIDVDLLPETHRRVRLHKHGSDRPLGFYIRDGMSVRVAPQGLERVPGIFISRLVRGGLAESTGLLAVSDEILEVNGIEVAGKTLDQVTDMMVANSHNLIVTVKPANQRNNVVRGASGRLTGPPSAGPGPAEPDSDDDSSDLVIENRQPPSSNGLSQGPPCWDLHPGCRHPGTRSSLPSLDDQEQASSGWGSRIRGDGSGFSL

SEQ ID NO: 61207 - protein, 345 aa, Homo sapiens
  Payload ID: 12227
  Gene Symbol: PARD6A
  Gene Name: par-6 family cell polarity regulator alpha
  Uniprot ID: Q9NPB6
  ENSP ID: ENSP00000392388
MARPQRTPARSPDSIVEVKSKFDAEFRRFALPRASVSGFQEFSRLLRAVHQIPGLDVLLGYTDAHGDLLPLTNDDSLHRALASGPPPLRLLVQKREADSSGLAFASNSLQRRKKGLLLRPVAPLRTRPPLLISLPQDFRQVSSVIDVDLLPETHRRVRLHKHGSDRPLGFYIRDGMSVRVAPQGLERVPGIFISRLVRGGLAESTGLLAVSDEILEVNGIEVAGKTLDQVTDMMVANSHNLIVTVKPANQRNNVVRGASGRLTGPPSAGPGPAEPDSDDDSSDLVIENRQPPSSNGLSQGPPCWDLHPGCRHPGTRSSLPSLDDQEQASSGWGSRIRGDGSGFSL

SEQ ID NO: 61208 - protein, 316 aa, Homo sapiens
  Payload ID: 12227
  Gene Symbol: PARD6A
  Gene Name: par-6 family cell polarity regulator alpha
  ENSP ID: ENSP00000473257
MARPQRTPARSPDSIVEVKSKFDAEFRRFALPRASVSGFQEFSRLLRAVHQIPGLDVLLGYTDAHAEADSSGLAFASNSLQRRKKGLLLRPVAPLRTRPPLLISLPQDFRQVSSVIDVDLLPETHRRVRLHKHGSDRPLGFYIRDGMSVRVAPQGLERVPGIFISRLVRGGLAESTGLLAVSDEILEVNGIEVAGKTLDQVTDMMVANSHNLIVTVKPANQRNNVVRGASGRLTGPPSAGPGPAEPDSDDDSSDLVIENRQPPSSNGLSQGPPCWDLHPGCRHPGTRSSLPSLDDQEQASSGWGSRIRGDGSGFSL

SEQ ID NO: 61209 - protein, 372 aa, Homo sapiens
  Payload ID: 12228
  Gene Symbol: PARD6B
  Gene Name: par-6 family cell polarity regulator beta
  Uniprot ID: Q9BYG5
  ENSP ID: ENSP00000360672
MNRSHRHGAGSGCLGTMEVKSKFGAEFRRFSLERSKPGKFEEFYGLLQHVHKIPNVDVLVGYADIHGDLLPINNDDNYHKAVSTANPLLRIFIQKKEEADYSAFGTDTLIKKKNVLTNVLRPDNHRKKPHIVISMPQDFRPVSSIIDVDILPETHRRVRLYKYGTEKPLGFYIRDGSSVRVTPHGLEKVPGIFISRLVPGGLAQSTGLLAVNDEVLEVNGIEVSGKSLDQVTDMMIANSRNLIITVRPANQRNNVVRNSRTSGSSGQSTDNSLLGYPQQIEPSFEPEDEDSEEDDIIIEDNGVPQQIPKAVPNTESLESLTQIELSFESGQNGFIPSNEVSLAAIASSSNTEFETHAPDQKLLEEDGTIITL

SEQ ID NO: 61210 - protein, 115 aa, Homo sapiens
  Payload ID: 12228
  Gene Symbol: PARD6B
  Gene Name: par-6 family cell polarity regulator beta
  Uniprot ID: Q9BYG5
  ENSP ID: ENSP00000379354
MNRSHRHGAGSGCLGTMEVKSKFGAEFRRFSLERSKPGKFEEFYGLLQHVHKIPNVDVLVGYADIHGDLLPINNDDNYHKAVSTANPLLRIFIQKKGCVLEHSKNNVRMPCLKTL

SEQ ID NO: 61211 - protein, 376 aa, Homo sapiens
  Payload ID: 12229
  Gene Symbol: PARD6G
  Gene Name: par-6 family cell polarity regulator gamma
  Uniprot ID: Q9BYG4
  ENSP ID: ENSP00000343144
MNRSFHKSQTLRFYDCSAVEVKSKFGAEFRRFSLDRHKPGKFEDFYKLVVHTHHISNSDVTIGYADVHGDLLPINNDDNFCKAVSSANPLLRVFIQKREEAERGSLGAGSLCRRRRALGALRDEGPRRRAHLDIGLPRDFRPVSSIIDVDLVPETHRRVRLHRHGCEKPLGFYIRDGASVRVTPHGLEKVPGIFISRMVPGGLAESTGLLAVNDEVLEVNGIEVAGKTLDQVTDMMIANSHNLIVTVKPANQRNNVVRGGRALGSSGPPSDGTAGFVGPPAPRVLQNFHPDEAESDEDNDVVIEGTLEPARPPQTPGAPAGSLSRVNGAGLAQRLQRDLALDGGLQRLLSSLRADPRHSLALPPGGVEEHGPAVTL

SEQ ID NO: 61212 - protein, 61 aa, Homo sapiens
  Payload ID: 12229
  Gene Symbol: PARD6G
  Gene Name: par-6 family cell polarity regulator gamma
  ENSP ID: ENSP00000466076
FEDFYKLVVHTHHISNSDVTIGYADVHGDLLPINNDDNFCKAVSSANPLLRVFIQKRGGEH

SEQ ID NO: 61213 - protein, 107 aa, Homo sapiens
  Payload ID: 12229
  Gene Symbol: PARD6G
  Gene Name: par-6 family cell polarity regulator gamma
  Uniprot ID: Q9BYG4
  ENSP ID: ENSP00000468735
MNRSFHKSQTLRFYDCSAVEVKSKFGAEFRRFSLDRHKPGKFEDFYKLVVHTHHISNSDVTIGYADVHGDLLPINNDDNFCKAVSSANPLLRVFIQKRDDGALRPGT

SEQ ID NO: 61214 - protein, 343 aa, Homo sapiens
  Payload ID: 12230
  Gene Symbol: PALM
  Gene Name: paralemmin
  Uniprot ID: O75781
  ENSP ID: ENSP00000264560
MEVLAAETTSQQERLQAIAEKRKRQAEIENKRRQLEDERRQLQHLKSKALRERWLLEGTPSSASEGDEDLRRQMQDDEQKTRLLEDSVSRLEKEIEVLERGDSAPATAKENAAAPSPVRAPAPSPAKEERKTEVVMNSQQTPVGTPKDKRVSNTPLRTVDGSPMMKAVVHAVDGTAENGIHPLSSSEVDELIHKADEVTLSEAGSTAGAAETRGAVEGAARTTPSRREITGVQAQPGEATSGPPGIQPGQEPPVTMIFMGYQNVEDEAETKKVLGLQDTITAELVVIEDAAEPKEPAPPNGSAAEPPTEAASREENQAGPEATTSDPQDLDMKKHRCKCCSIM

SEQ ID NO: 61215 - protein, 387 aa, Homo sapiens
  Payload ID: 12230
  Gene Symbol: PALM
  Gene Name: paralemmin
  Uniprot ID: O75781
  ENSP ID: ENSP00000341911
MEVLAAETTSQQERLQAIAEKRKRQAEIENKRRQLEDERRQLQHLKSKALRERWLLEGTPSSASEGDEDLRRQMQDDEQKTRLLEDSVSRLEKEIEVLERGDSAPATAKENAAAPSPVRAPAPSPAKEERKTEVVMNSQQTPVGTPKDKRVSNTPLRTVDGSPMMKAAMYSVEITVEKDKVTGETRVLSSTTLLPRQPLPLGIKVYEDETKVVHAVDGTAENGIHPLSSSEVDELIHKADEVTLSEAGSTAGAAETRGAVEGAARTTPSRREITGVQAQPGEATSGPPGIQPGQEPPVTMIFMGYQNVEDEAETKKVLGLQDTITAELVVIEDAAEPKEPAPPNGSAAEPPTEAASREENQAGPEATTSDPQDLDMKKHRCKCCSIM

SEQ ID NO: 61216 - protein, 242 aa, Homo sapiens
  Payload ID: 12230
  Gene Symbol: PALM
  Gene Name: paralemmin
  ENSP ID: ENSP00000477952
MNYKRVSNTPLRTVDGSPMMKAAMYSVEITVEKDKVTGETRVLSSTTLLPRQPLPLGIKVYEDETKVVHAVDGTAENGIHPLSSSEVDELIHKADEVTLSEAGSTAGAAETRGAVEGAARTTPSRREITGVQAQPGEATSGPPGIQPGQEPPVTMIFMGYQNVEDEAETKKVLGLQDTITAELVVIEDAAEPKEPAPPNGSAAEPPTEAASREENQAGPEATTSDPQDLDMKKHRCKCCSIM

SEQ ID NO: 61217 - protein, 198 aa, Homo sapiens
  Payload ID: 12230
  Gene Symbol: PALM
  Gene Name: paralemmin
  ENSP ID: ENSP00000480594
MNYKRVSNTPLRTVDGSPMMKAVVHAVDGTAENGIHPLSSSEVDELIHKADEVTLSEAGSTAGAAETRGAVEGAARTTPSRREITGVQAQPGEATSGPPGIQPGQEPPVTMIFMGYQNVEDEAETKKVLGLQDTITAELVVIEDAAEPKEPAPPNGSAAEPPTEAASREENQAGPEATTSDPQDLDMKKHRCKCCSIM

SEQ ID NO: 61218 - protein, 12 aa, Homo sapiens
  Payload ID: 12230
  Gene Symbol: PALM
  Gene Name: paralemmin
  ENSP ID: ENSP00000484090
MVLAAETTSQQE

SEQ ID NO: 61219 - protein, 411 aa, Homo sapiens
  Payload ID: 12231
  Gene Symbol: PALM2
  Gene Name: paralemmin 2
  Uniprot ID: Q8IXS6
  ENSP ID: ENSP00000323805
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 61220 - protein, 379 aa, Homo sapiens
  Payload ID: 12231
  Gene Symbol: PALM2
  Gene Name: paralemmin 2
  Uniprot ID: Q8IXS6
  ENSP ID: ENSP00000363656
MEMAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 61221 - protein, 377 aa, Homo sapiens
  Payload ID: 12231
  Gene Symbol: PALM2
  Gene Name: paralemmin 2
  ENSP ID: ENSP00000417525
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 61222 - protein, 180 aa, Homo sapiens
  Payload ID: 12231
  Gene Symbol: PALM2
  Gene Name: paralemmin 2
  ENSP ID: ENSP00000419747
MEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPE

SEQ ID NO: 61223 - protein, 673 aa, Homo sapiens
  Payload ID: 12232
  Gene Symbol: PALM3
  Gene Name: paralemmin 3
  Uniprot ID: A6NDB9
  ENSP ID: ENSP00000344996
MAESSLYRQRLEVIAEKRRLQEEIRAARREVEEEKLRVERLKRKSLRERWLMDGAAAVPEPSEDPTSKDPQSPEGQAQARIRNLEDSLFTLQSQLQLLQSASTGAQHKPSGRPSWRRQGHRPLSQSIVEAGSVGQTDLNKRASLPAGLVGTPPESPSEPREDVLGFLPGPRQVPGAAGDSSEANGPCPSPIPTPEQGLSQRAVPSEGRVGEAKGGGVVSVVWEGLRATEDCATGATGPELEAKVEEVVLEAIGDRKGAGSLELPAWVKEDRGIVEVVWEGVGGSDAEAMGEIGRVPEVVQTSSPRLQERLEAAASIEGEDVPQGSPEGDGQGGSGGEEGSFIWVERVTLSEEWEELLVEGLEGPEVAGRERGDESPLGAEGAKTGGGEETWEAEKRKAEESMGIGSEEKPGTGRDEAEMSPVVERKGGEKKLELESRGSAEKLGTEREGGEEPLGIERKVEGHLRAEKEGDEEKRGAEEEEVEEPLGVEKKGGEEEPEATKEPLEAERKGGEETLEAEKRGGEESLETEKTQGTEGDLNLEQGSREGSESQAEEMNEAGPPLEANTETRPEKEGPQPQEKPVGALEEEGVKPQTAAEGQGPLGDATPLLAETPAPEQPAECQPLLQGEGPSANPSAHPVPTYAPARQPEPSAPTEGEEASGPKQKTCQCCAVM

SEQ ID NO: 61224 - protein, 193 aa, Homo sapiens
  Payload ID: 12232
  Gene Symbol: PALM3
  Gene Name: paralemmin 3
  ENSP ID: ENSP00000465701
MDGAAAVPEPSEDPTSKDPQSPEGQAQARIRNLEDSLFTLQSQLQLLQSASTGAQHKPSGRPSWRRQGHRPLSQSIVEAGSVGQTDLNKRASLPAGLVGTPPESPSEPREDVLGFLPGPRQVPGAAGDSSEANGPCPSPIPTPEQGLSQRAVPSEGRVGEAKGGGVVSVVWEGLRATEDCATGATGPELEAKV

SEQ ID NO: 61225 - protein, 353 aa, Homo sapiens
  Payload ID: 12233
  Gene Symbol: PNMA1
  Gene Name: paraneoplastic Ma antigen 1
  Uniprot ID: Q8ND90
  ENSP ID: ENSP00000318914
MAMTLLEDWCRGMDVNSQRALLVWGIPVNCDEAEIEETLQAAMPQVSYRMLGRMFWREENAKAALLELTGAVDYAAIPREMPGKGGVWKVLFKPPTSDAEFLERLHLFLAREGWTVQDVARVLGFQNPTPTPGPEMPAEMLNYILDNVIQPLVESIWYKRLTLFSGRDIPGPGEETFDPWLEHTNEVLEEWQVSDVEKRRRLMESLRGPAADVIRILKSNNPAITTAECLKALEQVFGSVESSRDAQIKFLNTYQNPGEKLSAYVIRLEPLLQKVVEKGAIDKDNVNQARLEQVIAGANHSGAIRRQLWLTGAGEGPAPNLFQLLVQIREEEAKEEEEEAEATLLQLGLEGHF

SEQ ID NO: 61226 - protein, 364 aa, Homo sapiens
  Payload ID: 12234
  Gene Symbol: PNMA2
  Gene Name: paraneoplastic Ma antigen 2
  Uniprot ID: Q9UL42
  ENSP ID: ENSP00000429344
MALALLEDWCRIMSVDEQKSLMVTGIPADFEEAEIQEVLQETLKSLGRYRLLGKIFRKQENANAVLLELLEDTDVSAIPSEVQGKGGVWKVIFKTPNQDTEFLERLNLFLEKEGQTVSGMFRALGQEGVSPATVPCISPELLAHLLGQAMAHAPQPLLPMRYRKLRVFSGSAVPAPEEESFEVWLEQATEIVKEWPVTEAEKKRWLAESLRGPALDLMHIVQADNPSISVEECLEAFKQVFGSLESRRTAQVRYLKTYQEEGEKVSAYVLRLETLLRRAVEKRAIPRRIADQVRLEQVMAGATLNQMLWCRLRELKDQGPPPSFLELMKVIREEEEEEASFENESIEEPEERDGYGRWNHEGDD

SEQ ID NO: 61227 - protein, 463 aa, Homo sapiens
  Payload ID: 12235
  Gene Symbol: PNMA3
  Gene Name: paraneoplastic Ma antigen 3
  Uniprot ID: Q9UL41
  ENSP ID: ENSP00000390576
MPLTLLQDWCRGEHLNTRRCMLILGIPEDCGEDEFEETLQEACRHLGRYRVIGRMFRREENAQAILLELAQDIDYALLPREIPGKGGPWEVIVKPRNSDGEFLNRLNRFLEEERRTVSDMNRVLGSDTNCSAPRVTISPEFWTWAQTLGAAVQPLLEQMLYRELRVFSGNTISIPGALAFDAWLEHTTEMLQMWQVPEGEKRRRLMECLRGPALQVVSGLRASNASITVEECLAALQQVFGPVESHKIAQVKLCKAYQEAGEKVSSFVLRLEPLLQRAVENNVVSRRNVNQTRLKRVLSGATLPDKLRDKLKLMKQRRKPPGFLALVKLLREEEEWEATLGPDRESLEGLEVAPRPPARITGVGAVPLPASGNSFDARPSQGYRRRRGRGQHRRGGVARAGSRGSRKRKRHTFCYSCGEDGHIRVQCINPSNLLLVKQKKQAAVESGNGNWAWDKSHPKSKAK

SEQ ID NO: 61228 - protein, 463 aa, Homo sapiens; identical to SEQ ID NO: 61227
  Payload ID: 12235
  Gene Symbol: PNMA3
  Gene Name: paraneoplastic Ma antigen 3
  Uniprot ID: Q9UL41
  ENSP ID: ENSP00000469445

SEQ ID NO: 61229 - protein, 455 aa, Homo sapiens
  Payload ID: 12235
  Gene Symbol: PNMA3
  Gene Name: paraneoplastic Ma antigen 3
  Uniprot ID: Q9UL41
  ENSP ID: ENSP00000480719
MPLTLLQDWCRGEHLNTRRCMLILGIPEDCGEDEFEETLQEACRHLGRYRVIGRMFRREENAQAILLELAQDIDYALLPREIPGKGGPWEVIVKPRNSDGEFLNRLNRFLEEERRTVSDMNRVLGSDTNCSAPRVTISPEFWTWAQTLGAAVQPLLEQMLYRELRVFSGNTISIPGALAFDAWLEHTTEMLQMWQVPEGEKRRRLMECLRGPALQVVSGLRASNASITVEECLAALQQVFGPVESHKIAQVKLCKAYQEAGEKVSSFVLRLEPLLQRAVENNVVSRRNVNQTRLKRVLSGATLPDKLRDKLKLMKQRRKPPGFLALVKLLREEEEWEATLGPDRESLEGLEVAPRPPARITGVGAVPLPASGNSFDARPSQGYRRRRGRGQHRRGGVARAGSRGSRKRKRHTFCYSCGEDGHIRVQCINPSNLLLAKETKEILEGGEREAQTNSR

SEQ ID NO: 61230 - protein, 448 aa, Homo sapiens
  Payload ID: 12236
  Gene Symbol: PNMA5
  Gene Name: paraneoplastic Ma antigen family member 5
  Uniprot ID: Q96PV4
  ENSP ID: ENSP00000354834
MALTLLEDWCKGMDMDPRKALLIVGIPMECSEVEIQDTVKAGLQPLCAYRVLGRMFRREDNAKAVFIELADTVNYTTLPSHIPGKGGSWEVVVKPRNPDDEFLSRLNYFLKDEGRSMTDVARALGCCSLPAESLDAEVMPQVRSPPLEPPKESMWYRKLKVFSGTASPSPGEETFEDWLEQVTEIMPIWQVSEVEKRRRLLESLRGPALSIMRVLQANNDSITVEQCLDALKQIFGDKEDFRASQFRFLQTSPKIGEKVSTFLLRLEPLLQKAVHKSPLSVRSTDMIRLKHLLARVAMTPALRGKLELLDQRGCPPNFLELMKLIRDEEEWENTEAVMKNKEKPSGRGRGASGRQARAEASVSAPQATVQARSFSDSSPQTIQGGLPPLVKRRRLLGSESTRGEDHGQATYPKAENQTPGREGPQAAGEELGNEAGAGAMSHPKPWET

SEQ ID NO: 61231 - protein, 448 aa, Homo sapiens; identical to SEQ ID NO: 61230
  Payload ID: 12236
  Gene Symbol: PNMA5
  Gene Name: paraneoplastic Ma antigen family member 5
  Uniprot ID: Q96PV4
  ENSP ID: ENSP00000388850

SEQ ID NO: 61232 - protein, 140 aa, Homo sapiens
  Payload ID: 12236
  Gene Symbol: PNMA5
  Gene Name: paraneoplastic Ma antigen family member 5
  ENSP ID: ENSP00000391130
MALTLLEDWCKGMDMDPRKALLIVGIPMECSEVEIQDTVKAGLQPLCAYRVLGRMFRREDNAKAVFIELADTVNYTTLPSHIPGKGGSWEVVVKPRNPDDEFLSRLNYFLKDEGRSMTDVARALGCCSLPAESLDAEVMP

SEQ ID NO: 61233 - protein, 448 aa, Homo sapiens; identical to SEQ ID NO: 61230
  Payload ID: 12236
  Gene Symbol: PNMA5
  Gene Name: paraneoplastic Ma antigen family member 5
  Uniprot ID: Q96PV4
  ENSP ID: ENSP00000392342

SEQ ID NO: 61234 - protein, 448 aa, Homo sapiens; identical to SEQ ID NO: 61230
  Payload ID: 12236
  Gene Symbol: PNMA5
  Gene Name: paraneoplastic Ma antigen family member 5
  Uniprot ID: Q96PV4
  ENSP ID: ENSP00000445775

SEQ ID NO: 61235 - protein, 399 aa, Homo sapiens
  Payload ID: 12237
  Gene Symbol: PNMA6A
  Gene Name: paraneoplastic Ma antigen family member 6A
  Uniprot ID: P0CW24
  ENSP ID: ENSP00000391488
MAVTMLQDWCRWMGVNARRGLLILGIPEDCDDAEFQESLEAALRPMGHFTVLGKAFREEDNATAALVELDREVNYALVPREIPGTGGPWNVVFVPRCSGEEFLGLGRVFHFPEQEGQMVESVAGALGVGLRRVCWLRSIGQAVQPWVEAVRCQSLGVFSGRDQPAPGEESFEVWLDHTTEMLHVWQGVSERERRRRLLEGLRGTALQLVHALLAENPARTAQDCLAALAQVFGDNESQATIRVKCLTAQQQSGERLSAFVLRLEVLLQKAMEKEALARASADRVRLRQMLTRAHLTEPLDEALRKLRMAGRSPSFLEMLGLVRESEAWEASLARSVRAQTQEGAGARAGAQAVARASTKVEAVPGGPGREPEGLLQAGGQEAEELLQEGLKPVLEECDN

SEQ ID NO: 61236 - protein, 439 aa, Homo sapiens
  Payload ID: 12238
  Gene Symbol: PNMAL1
  Gene Name: paraneoplastic Ma antigen family-like 1
  Uniprot ID: Q86V59
  ENSP ID: ENSP00000318131
MSKTMAMNLLEDWCRGMEVDIHRSLLVTGIPEDCGQAEIEETLNGVLSPLGPYRVLNKIFVREENVKAALIEVGEGVNLSTIPREFPGRGGVWRVVCRDPTQDAEFLKNLNEFLDAEGRTWEDVVRLLQLNHPTLSQNQHQPPENWAEALGVLLGAVVQIIFCMDAEIRSREEARAQEAAEFEEMAAWALAAGRKVKKEPGLAAEVGSALKAETPNNWNATEDQHEPTKPLVRRAGAKSRSRRKKQKKNSRQEAVPWKKPKGINSNSTANLEDPEVGDAESMAISEPIKGSRKPCVNKEELALKKPMAKCAWKGPREPPQDARAEAESPGGASESDQDGGHESPPKKKAVAWVSAKNPAPMRKKKKVSLGPVSYVLVDSEDGRKKPVMPKKGPGSRREASDQKAPRGQQPAEATASTSRGPKAKPEGSPRRATNESRKV

SEQ ID NO: 61237 - protein, 378 aa, Homo sapiens
  Payload ID: 12238
  Gene Symbol: PNMAL1
  Gene Name: paraneoplastic Ma antigen family-like 1
  Uniprot ID: Q86V59
  ENSP ID: ENSP00000410273
MSKTMAMNLLEDWCRGMEVDIHRSLLVTGIPEDCGQAEIEETLNGVLSPLGPYRVLNKIFVREENVKAALIEVGEGVNLSTIPREFPGRGGVWRVVCRDPTQDAEFLKNLNEFLDAEGRTWEDVVRLLQLNHPTLSQNQHQPPENWAEALGVLLGAVVQIIFCMDAEIRSREEARAQEAAEFEEMAAWALAAGRKVKKEPGLAAEVGSALKAETPNNWNATEDQHEPTKPLVRRAGAKSRSRRKKQKKNSRQEAVPWKKPKGINSNSTANLEDPEVGDAESMAISEPIKGSRKPCVNKEELALKKPMAKCAWKGPREPPQDARAEAESPGGASESDQDGGHESPPKKKAVAWVSAKNPAPMRKKKKNPERFDLGDHPY

SEQ ID NO: 61238 - protein, 84 aa, Homo sapiens
  Payload ID: 12238
  Gene Symbol: PNMAL1
  Gene Name: paraneoplastic Ma antigen family-like 1
  ENSP ID: ENSP00000473064
MSKTMAMNLLEDWCRGMEVDIHRSLLVTGIPEDCGQAEIEETLNGVLSPLGPYRVLNKIFVREENVKAALIENPERFDLGDHPY

SEQ ID NO: 61239 - protein, 635 aa, Homo sapiens
  Payload ID: 12239
  Gene Symbol: PNMAL2
  Gene Name: paraneoplastic Ma antigen family-like 2
  Uniprot ID: Q9ULN7
  ENSP ID: ENSP00000473036
MAMSLLQDWCRSLDVDAHRALLVTGIPEGLEQADVEAVLQPTLLPLGTFRLRHMKALMNEKAQAALVEFVEDVNHAAIPREIPGKDGVWRVLWKDRAQDTRVLRQMRRLLLDDGPTQAAEAGTPGEAPTPPASETQAQDSGEVTGQAGSLLGAARNPRRGRRGRRNRTRRNRLTQKGKKRSRGGRPSAPARSEAEDSSDESLGIVIEEIDQGDLSGEEDQSALYATLQAAARELVRQWAPCNSEGEEDGPREFLALVTVTDKSKKEEAEKEPAGAESIRLNTKEDKNGVPDLVALLAVRDTPDEEPVDSDTSESDSQESGDQETEELDNPEFVAIVAYTDPSDPWAREEMLKIASVIESLGWSDEKDKRDPLRQVLSVMSKDTNGTRVKVEEAGREVDAVVLRKAGDDGDLRECISTLAQPDLPPQAKKAGRGLFGGWSEHREDEGGLLELVALLAAQDMAEVMKEEKENAWEGGKYKYPKGKLGEVLALLAARENMGSNEGSEEASDEQSEEESEDTESEASEPEDRASRKPRAKRARTAPRGLTPAGAPPTASGARKTRAGGRGRGRGVTPEKKAGSRGSAQDDAAGSRKKKGSAGAGAHARAGEAKGQAPTGSKAARGKKARRGRRLPPKCR

SEQ ID NO: 61240 - protein, 355 aa, Homo sapiens [sequence omitted]

SEQ ID NO: 61241 - protein, 77 aa, Homo sapiens
  Payload ID: 12240
  Gene Symbol: PON1
  Gene Name: paraoxonase 1
  ENSP ID: ENSP00000407359
MAKLIALTLLGMGLALFRNHQSSYQTRLNALREVQPVELPNCNLVKGIETGSEDLEILPNGLAFISSSWKNTSDGPE

SEQ ID NO: 61242 - protein, 354 aa, Homo sapiens
  Payload ID: 12241
  Gene Symbol: PON2
  Gene Name: paraoxonase 2
  Uniprot ID: Q15165
  ENSP ID: ENSP00000222572
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 61243 - protein, 342 aa, Homo sapiens
  Payload ID: 12241
  Gene Symbol: PON2
  Gene Name: paraoxonase 2
  ENSP ID: ENSP00000404622
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 61244 - protein, 50 aa, Homo sapiens
  Payload ID: 12241
  Gene Symbol: PON2
  Gene Name: paraoxonase 2
  Uniprot ID: Q15165
  ENSP ID: ENSP00000405211
MGRLVAVGLLGIALALLGERLLALRNRLKASREVESVDLPHCHLIKGIVW

SEQ ID NO: 61245 - protein, 219 aa, Homo sapiens
  Payload ID: 12241
  Gene Symbol: PON2
  Gene Name: paraoxonase 2
  ENSP ID: ENSP00000414515
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVYLCC

SEQ ID NO: 61246 - protein, 32 aa, Homo sapiens
  Payload ID: 12241
  Gene Symbol: PON2
  Gene Name: paraoxonase 2
  ENSP ID: ENSP00000487703
MMDLKEEKPRARELRISRGFDLASFNPHGIST

SEQ ID NO: 61247 - protein, 84 aa, Homo sapiens
  Payload ID: 12241
  Gene Symbol: PON2
  Gene Name: paraoxonase 2
  ENSP ID: ENSP00000487898
MGRLVAVGLLGIALALLGERLLALRNRLKASREVESVDLPHCHLIKGIEAGSEDIDILPNGLAFFSVVSVFFLPQIQQRRYKGI

SEQ ID NO: 61248 - protein, 375 aa, Homo sapiens
  Payload ID: 12241
  Gene Symbol: PON2
  Gene Name: paraoxonase 2
  ENSP ID: ENSP00000488378
MAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 61249 - protein, 84 aa, Homo sapiens; identical to SEQ ID NO: 61247
  Payload ID: 12241
  Gene Symbol: PON2
  Gene Name: paraoxonase 2
  ENSP ID: ENSP00000488462

SEQ ID NO: 61250 - protein, 113 aa, Homo sapiens
  Payload ID: 12241
  Gene Symbol: PON2
  Gene Name: paraoxonase 2
  ENSP ID: ENSP00000488550
MMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNL

SEQ ID NO: 61251 - protein, 53 aa, Homo sapiens
  Payload ID: 12241
  Gene Symbol: PON2
  Gene Name: paraoxonase 2
  ENSP ID: ENSP00000488822
MMDLKEEKPRARELRISRGFDLASFNPHGISTFIDNDDTVYLFVVNHPEFKNT

SEQ ID NO: 61252 - protein, 69 aa, Homo sapiens
  Payload ID: 12241
  Gene Symbol: PON2
  Gene Name: paraoxonase 2
  ENSP ID: ENSP00000488826
MMDLKEEKPRARELRISRGFDLASFNPHGISTFIDNDDTVYLFVVNHPEFKNTVEIFKFEEAENSLLHL

SEQ ID NO: 61253 - protein, 354 aa, Homo sapiens; identical to SEQ ID NO: 61242
  Payload ID: 12241
  Gene Symbol: PON2
  Gene Name: paraoxonase 2
  ENSP ID: ENSP00000488838

SEQ ID NO: 61254 - protein, 122 aa, Homo sapiens
  Payload ID: 12241
  Gene Symbol: PON2
  Gene Name: paraoxonase 2
  ENSP ID: ENSP00000488874
  MOD_RES (1)..(1): Any amino acid
XENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKILTISHLEGT

SEQ ID NO: 61255 - protein, 354 aa, Homo sapiens
  Payload ID: 12242
  Gene Symbol: PON3
  Gene Name: paraoxonase 3
  Uniprot ID: Q15166
  ENSP ID: ENSP00000265627
MGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 61256 - protein, 46 aa, Homo sapiens
  Payload ID: 12242
  Gene Symbol: PON3
  Gene Name: paraoxonase 3
  ENSP ID: ENSP00000390253
MGKLVALVLLGVGLSLVGEMFLAFRVGFYLLQRKGECLSRSGASRT

SEQ ID NO: 61257 - protein, 61 aa, Homo sapiens
  Payload ID: 12242
  Gene Symbol: PON3
  Gene Name: paraoxonase 3
  ENSP ID: ENSP00000391072
MGKLVALVLLGVGLSLVGEMFLAFRERVNASREVEPVEPENCHLIEELGIKISRHAKLCAR

SEQ ID NO: 61258 - protein, 46 aa, Homo sapiens; identical to SEQ ID NO: 61256
  Payload ID: 12242
  Gene Symbol: PON3
  Gene Name: paraoxonase 3
  ENSP ID: ENSP00000393174

SEQ ID NO: 61259 - protein, 270 aa, Homo sapiens
  Payload ID: 12242
  Gene Symbol: PON3
  Gene Name: paraoxonase 3
  ENSP ID: ENSP00000403850
MGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKETFWQDAILIL

SEQ ID NO: 61260 - protein, 245 aa, Homo sapiens
  Payload ID: 12242
  Gene Symbol: PON3
  Gene Name: paraoxonase 3
  ENSP ID: ENSP00000413276
MGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYFASRMFCLRSPG

SEQ ID NO: 61261 - protein, 523 aa, Homo sapiens
  Payload ID: 12243
  Gene Symbol: PSPC1
  Gene Name: paraspeckle component 1
  Uniprot ID: Q8WXF1
  ENSP ID: ENSP00000343966
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENREQEMRMGDMGPRGAINMGDAFSPAPAGNQGPPPMMGMNMNNRATIPGPPMGPGPAMGPEGAANMGTPMMPDNGAVHNDRFPQGPPSQMGSPMGSRTGSETPQAPMSGVGPVSGGPGGFGRGSQGGNFEGPNKRRRY

SEQ ID NO: 61262 - protein, 248 aa, Homo sapiens
  Payload ID: 12243
  Gene Symbol: PSPC1
  Gene Name: paraspeckle component 1
  ENSP ID: ENSP00000393069
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKL

SEQ ID NO: 61263 - protein, 393 aa, Homo sapiens
  Payload ID: 12243
  Gene Symbol: PSPC1
  Gene Name: paraspeckle component 1
  Uniprot ID: Q8WXF1
  ENSP ID: ENSP00000435921
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENGDKRKCG

SEQ ID NO: 61264 - protein, 393 aa, Homo sapiens; identical to SEQ ID NO: 61263
  Payload ID: 12243
  Gene Symbol: PSPC1
  Gene Name: paraspeckle component 1
  Uniprot ID: Q8WXF1
  ENSP ID: ENSP00000436038

SEQ ID NO: 61265 - protein, 523 aa, Homo sapiens; identical to SEQ ID NO: 61261
  Payload ID: 12243
  Gene Symbol: PSPC1
  Gene Name: paraspeckle component 1
  Uniprot ID: Q8WXF1
  ENSP ID: ENSP00000481916

SEQ ID NO: 61266 - protein, 33 aa, Homo sapiens
  Payload ID: 12243
  Gene Symbol: PSPC1
  Gene Name: paraspeckle component 1
  ENSP ID: ENSP00000488975
EEMIRHREQEELRRQQEGFKPNYMENYVCHFLR

SEQ ID NO: 61267 - protein, 102 aa, Homo sapiens
  Payload ID: 12244
  Gene Symbol: PTMS
  Gene Name: parathymosin
  Uniprot ID: P20962
  ENSP ID: ENSP00000310088
MSEKSVEAAAELSAKDLKEKKEKVEEKASRKERKKEVVEEEENGAEEEEEETAEDGEEEDEGEEEDEEEEEEDDEGPALKRAAEEEDEADPKRQKTENGASA

SEQ ID NO: 61268 - protein, 104 aa, Homo sapiens
  Payload ID: 12244
  Gene Symbol: PTMS
  Gene Name: parathymosin
  ENSP ID: ENSP00000374113
MSEKSVEAAAELSAKDLKEKKEKVEEKASRKERKKEVVEAPVPLVVMVGKACSQPEATPSPGPHRRRRTGLRRKKKKLPRMERRKMKGKKKMRKKKKRMMKGPR

SEQ ID NO: 61269 - protein, 57 aa, Homo sapiens
  Payload ID: 12244
  Gene Symbol: PTMS
  Gene Name: parathymosin
  ENSP ID: ENSP00000442325
MSEKSVEAAAELSAKDLKEKKEKVEEKASRKERKKEVVEAPVPLVVMVGKACSQPEA

SEQ ID NO: 61270 - protein, 102 aa, Homo sapiens; identical to SEQ ID NO: 61267
  Payload ID: 12244
  Gene Symbol: PTMS
  Gene Name: parathymosin
  Uniprot ID: P20962
  ENSP ID: ENSP00000478828

SEQ ID NO: 61271 - protein, 115 aa, Homo sapiens
  Payload ID: 12245
  Gene Symbol: PTH
  Gene Name: parathyroid hormone
  Uniprot ID: P01270
  ENSP ID: ENSP00000282091
MIPAKDMAKVMIVMLAICFLTKSDGKSVKKRSVSEIQLMHNLGKHLNSMERVEWLRKKLQDVHNFVALGAPLAPRDAGSQRPRKKEDNVLVESHEKSLGEADKADVNVLTKAKSQ

SEQ ID NO: 61272 - protein, 115 aa, Homo sapiens; identical to SEQ ID NO: 61271
  Payload ID: 12245
  Gene Symbol: PTH
  Gene Name: parathyroid hormone
  Uniprot ID: P01270
  ENSP ID: ENSP00000433208

SEQ ID NO: 61273 - protein, 593 aa, Homo sapiens
  Payload ID: 12246
  Gene Symbol: PTH1R
  Gene Name: parathyroid hormone 1 receptor
  Uniprot ID: Q03431
  ENSP ID: ENSP00000321999
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGLPAVFVAVWVSVRATLANTGCWDLSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTATTNGHPQLPGHAKPGTPALETLETTPPAMAAPKDDGFLNGSCSGLDEEASGPERPPALLQEEWETVM

SEQ ID NO: 61274 - protein, 333 aa, Homo sapiens
  Payload ID: 12246
  Gene Symbol: PTH1R
  Gene Name: parathyroid hormone 1 receptor
  ENSP ID: ENSP00000389811
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGAGT

SEQ ID NO: 61275 - protein, 182 aa, Homo sapiens
  Payload ID: 12246
  Gene Symbol: PTH1R
  Gene Name: parathyroid hormone 1 receptor
  ENSP ID: ENSP00000396176
YTEVSGTLWQVQMHYEMLFNSFQGFFVAIIYCFCNGENTPEDILKAEKSFQMMQVQAEIKKSWSRWTLALDFKRKARSGSSSYSYGPMVSHTSVTNVGPRVGLGLPLSPRLLPTATTNGHPQLPGHAKPGTPALETLETTPPAMAAPKDDGFLNGSCSGLDEEASGPERPPALLQEEWETVM

SEQ ID NO: 61276 - protein, 527 aa, Homo sapiens
  Payload ID: 12246
  Gene Symbol: PTH1R
  Gene Name: parathyroid hormone 1 receptor
  ENSP ID: ENSP00000400977
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGLPAVFVAVWVSVRATLANTGCWDLSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTAT

SEQ ID NO: 61277 - protein, 593 aa, Homo sapiens; identical to SEQ ID NO: 61273
  Payload ID: 12246
  Gene Symbol: PTH1R
  Gene Name: parathyroid hormone 1 receptor
  Uniprot ID: Q03431
  ENSP ID: ENSP00000402723

SEQ ID NO: 61278 - protein, 593 aa, Homo sapiens; identical to SEQ ID NO: 61273
  Payload ID: 12246
  Gene Symbol: PTH1R
  Gene Name: parathyroid hormone 1 receptor
  Uniprot ID: Q03431
  ENSP ID: ENSP00000411424

SEQ ID NO: 61279 - protein, 593 aa, Homo sapiens; identical to SEQ ID NO: 61273
  Payload ID: 12246
  Gene Symbol: PTH1R
  Gene Name: parathyroid hormone 1 receptor
  Uniprot ID: Q03431
  ENSP ID: ENSP00000413774

SEQ ID NO: 61280 - protein, 100 aa, Homo sapiens
  Payload ID: 12247
  Gene Symbol: PTH2
  Gene Name: parathyroid hormone 2
  Uniprot ID: Q96A98
  ENSP ID: ENSP00000270631
METRQVSRSPRVRLLLLLLLLLVVPWGVRTASGVALPPVGVLSLRPPGRAWADPATPRPRRSLALADDAAFRERARLLAALERRHWLNSYMHKLLVLDAP

SEQ ID NO: 61281 - protein, 550 aa, Homo sapiens
  Payload ID: 12248
  Gene Symbol: PTH2R
  Gene Name: parathyroid hormone 2 receptor
  Uniprot ID: P49190
  ENSP ID: ENSP00000272847
MAGLGASLHVWGWLMLGSCLLARAQLDSDGTITIEEQIVLVLKAKVQCELNITAQLQEGEGNCFPEWDGLICWPRGTVGKISAVPCPPYIYDFNHKGVAFRHCNPNGTWDFMHSLNKTWANYSDCLRFLQPDISIGKQEFFERLYVMYTVGYSISFGSLAVAILIIGYFRRLHCTRNYIHMHLFVSFMLRATSIFVKDRVVHAHIGVKELESLIMQDDPQNSIEATSVDKSQYIGCKIAVVMFIYFLATNYYWILVEGLYLHNLIFVAFFSDTKYLWGFILIGWGFPAAFVAAWAVARATLADARCWELSAGDIKWIYQAPILAAIGLNFILFLNTVRVLATKIWETNAVGHDTRKQYRKLAKSTLVLVLVFGVHYIVFVCLPHSFTGLGWEIRMHCELFFNSFQGFFVSIIYCYCNGEVQAEVKKMWSRWNLSVDWKRTPPCGSRRCGSVLTTVTHSTSSQSQVAASTRMVLISGKAAKIASRQPDSHITLPGYVWSNSEQDCLPHSFHEETKEDSGRQGDDILMEKPSRPMESNPDTEGCQGETEDVL

SEQ ID NO: 61282 - protein, 54 aa, Homo sapiens
  Payload ID: 12248
  Gene Symbol: PTH2R
  Gene Name: parathyroid hormone 2 receptor
  ENSP ID: ENSP00000393930
  MOD_RES (1)..(1): Any amino acid
XSFTGLGWEIRMHCELFFNSFQGFFVSIIYCYCNGEIGRLLCMDKIPATASLTP

SEQ ID NO: 61283 - protein, 439 aa, Homo sapiens
  Payload ID: 12248
  Gene Symbol: PTH2R
  Gene Name: parathyroid hormone 2 receptor
  ENSP ID: ENSP00000482485
MHSLNKTWANYSDCLRFLQPDISIGKQEFFERLYVMYTVGYSISFGSLAVAILIIGYFRRLHCTRNYIHMHLFVSFMLRATSIFVKDRVVHAHIGVKELESLIMQDDPQNSIEATSVDKSQYIGCKIAVVMFIYFLATNYYWILVEGLYLHNLIFVAFFSDTKYLWGFILIGWGFPAAFVAAWAVARATLADARCWELSAGDIKWIYQAPILAAIGLNFILFLNTVRVLATKIWETNAVGHDTRKQYRKLAKSTLVLVLVFGVHYIVFVCLPHSFTGLGWEIRMHCELFFNSFQGFFVSIIYCYCNGEVQAEVKKMWSRWNLSVDWKRTPPCGSRRCGSVLTTVTHSTSSQSQVAASTRMVLISGKAAKIASRQPDSHITLPGYVWSNSEQDCLPHSFHEETKEDSGRQGDDILMEKPSRPMESNPDTEGCQGETEDVL

SEQ ID NO: 61284 - protein, 175 aa, Homo sapiens
  Payload ID: 12249
  Gene Symbol: PTHLH
  Gene Name: parathyroid hormone-like hormone
  Uniprot ID: P12272
  ENSP ID: ENSP00000201015
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSR

SEQ ID NO: 61285 - protein, 175 aa, Homo sapiens; identical to SEQ ID NO: 61284
  Payload ID: 12249
  Gene Symbol: PTHLH
  Gene Name: parathyroid hormone-like hormone
  Uniprot ID: P12272
  ENSP ID: ENSP00000379209

SEQ ID NO: 61286 - protein, 177 aa, Homo sapiens
  Payload ID: 12249
  Gene Symbol: PTHLH
  Gene Name: parathyroid hormone-like hormone
  Uniprot ID: P12272
  ENSP ID: ENSP00000379213
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRRH

SEQ ID NO: 61287 - protein, 175 aa, Homo sapiens; identical to SEQ ID NO: 61284
  Payload ID: 12249
  Gene Symbol: PTHLH
  Gene Name: parathyroid hormone-like hormone
  Uniprot ID: P12272
  ENSP ID: ENSP00000440613

SEQ ID NO: 61288 - protein, 177 aa, Homo sapiens; identical to SEQ ID NO: 61286
  Payload ID: 12249
  Gene Symbol: PTHLH
  Gene Name: parathyroid hormone-like hormone
  Uniprot ID: P12272
  ENSP ID: ENSP00000441571

SEQ ID NO: 61289 - protein, 177 aa, Homo sapiens; identical to SEQ ID NO: 61286
  Payload ID: 12249
  Gene Symbol: PTHLH
  Gene Name: parathyroid hormone-like hormone
  Uniprot ID: P12272
  ENSP ID: ENSP00000441765

SEQ ID NO: 61290 - protein, 209 aa, Homo sapiens
  Payload ID: 12249
  Gene Symbol: PTHLH
  Gene Name: parathyroid hormone-like hormone
  Uniprot ID: P12272
  ENSP ID: ENSP00000441890
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRTALLWGLKKKKENNRRTHHMQLMISLFKSPLLLL

SEQ ID NO: 61291 - protein, 172 aa, Homo sapiens
  Payload ID: 12249
  Gene Symbol: PTHLH
  Gene Name: parathyroid hormone-like hormone
  ENSP ID: ENSP00000444519
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLEL

SEQ ID NO: 61292 - protein, 111 aa, Homo sapiens
  Payload ID: 12249
  Gene Symbol: PTHLH
  Gene Name: parathyroid hormone-like hormone
  ENSP ID: ENSP00000445157
MSRARAETMQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRY

SEQ ID NO: 61293 - protein, 296 aa, Homo sapiens
  Payload ID: 12250
  Gene Symbol: PACRG
  Gene Name: PARK2 co-regulated
  Uniprot ID: Q96M98
  ENSP ID: ENSP00000337946
MVAEKETLSLNKCPDKMPKRTKLLAQQPLPVHQPHSLVSEGFTVKAMMKNSVVRGPPAAGAFKERPTKPTAFRKFYERGDFPIALEHDSKGNKIAWKVEIEKLDYHHYLPLFFDGLCEMTFPYEFFARQGIHDMLEHGGNKILPVLPQLIIPIKNALNLRNRQVICVTLKVLQHLVVSAEMVGKALVPYYRQILPVLNIFKNMNGSYSLPRLECSGAIMARCNLDHLGSSDPPTSASQVAEIIVNSGDGIDYSQQKRENIGDLIQETLEAFERYGGENAFINIKYVVPTYESCLLN

SEQ ID NO: 61294 - protein, 257 aa, Homo sapiens
  Payload ID: 12250
  Gene Symbol: PACRG
  Gene Name: PARK2 co-regulated
  Uniprot ID: Q96M98
  ENSP ID: ENSP00000355854
MVAEKETLSLNKCPDKMPKRTKLLAQQPLPVHQPHSLVSEGFTVKAMMKNSVVRGPPAAGAFKERPTKPTAFRKFYERGDFPIALEHDSKGNKIAWKVEIEKLDYHHYLPLFFDGLCEMTFPYEFFARQGIHDMLEHGGNKILPVLPQLIIPIKNALNLRNRQVICVTLKVLQHLVVSAEMVGKALVPYYRQILPVLNIFKNMNVNSGDGIDYSQQKRENIGDLIQETLEAFERYGGENAFINIKYVVPTYESCLLN

SEQ ID NO: 61295 - protein, 257 aa, Homo sapiens; identical to SEQ ID NO: 61294
  Payload ID: 12250
  Gene Symbol: PACRG
  Gene Name: PARK2 co-regulated
  Uniprot ID: Q96M98
  ENSP ID: ENSP00000355855

SEQ ID NO: 61296 - protein, 127 aa, Homo sapiens
  Payload ID: 12250
  Gene Symbol: PACRG
  Gene Name: PARK2 co-regulated
  ENSP ID: ENSP00000438242
  MOD_RES (1)..(1): Any amino acid
XPVLPQLIIPIKNALNLRNRQVICVTLKVLQHLVVSAEMVGKALVPYYRQILPVLNIFKNMNVTHRQRSELSSMLAKWGGPDLLLVFLPFSTIIVCKSLIFILSQFMLPRLNSATNNMNVTHFIICN

SEQ ID NO: 61297 - protein, 62 aa, Homo sapiens
  Payload ID: 12250
  Gene Symbol: PACRG
  Gene Name: PARK2 co-regulated
  ENSP ID: ENSP00000440706
  MOD_RES (1)..(1): Any amino acid
XGPPAAGAFKERPTKPTAFRKFYERGDFPIALEHDSKGNKIAWKILGMKNYKTTSPWPLSNR

SEQ ID NO: 61298 - protein, 125 aa, Homo sapiens
  Payload ID: 12250
  Gene Symbol: PACRG
  Gene Name: PARK2 co-regulated
  ENSP ID: ENSP00000442879
  MOD_RES (1)..(1): Any amino acid
XEHDSKGNKIAWKVEIEKLDYHHYLPLFFDGLCEMTFPYEFFARQGIHDMLEHGGNKILPVLPQLIIPIKNALNLRNRQVICVTLKVLQHLVVSAEMVGKALVPYYRQILPVLNIFKNMNGWAPP

SEQ ID NO: 61299 - protein, 120 aa, Homo sapiens [sequence omitted]

SEQ ID NO: 61300 - protein, 92 aa, Homo sapiens
  Payload ID: 12250
  Gene Symbol: PACRG
  Gene Name: PARK2 co-regulated
  ENSP ID: ENSP00000481001
GSYSLPRLECSGAIMARCNLDHLGSSDPPTSASQVAEIIVNSGDGIDYSQQKRENIGDLIQETLEAFERYGGENAFINIKYVVPTYESCLLN

SEQ ID NO: 61301 - protein, 221 aa, Homo sapiens
  Payload ID: 12251
  Gene Symbol: PACRGL
  Gene Name: PARK2 co-regulated-like
  Uniprot ID: Q8N7B6
  ENSP ID: ENSP00000295290
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSKEGFRELLLVKGAPEKAIPLLPRLIPVLKAALVHSDDEVFERGLNALVQLSVVVGPSLNDHLKHLLTSGSLSIIKSKIPTYCSICC

SEQ ID NO: 61302 - protein, 221 aa, Homo sapiens; identical to SEQ ID NO: 61301
  Payload ID: 12251
  Gene Symbol: PACRGL
  Gene Name: PARK2 co-regulated-like
  Uniprot ID: Q8N7B6
  ENSP ID: ENSP00000354171

SEQ ID NO: 61303 - protein, 123 aa, Homo sapiens
  Payload ID: 12251
  Gene Symbol: PACRGL
  Gene Name: PARK2 co-regulated-like
  Uniprot ID: Q8N7B6
  ENSP ID: ENSP00000415832
MQKSEGSGGTQLKNRATGNYDQRTSSSTQLKHRNAVQGSKSSLSTSSPESARKLHPRPSDKLNPKTINPVHSDDEVFERGLNALVQLSVVVGPSLNDHLKHLLTSGSLSIIKSKIPTYCSICC

SEQ ID NO: 61304 - protein, 91 aa, Homo sapiens
  Payload ID: 12251
  Gene Symbol: PACRGL
  Gene Name: PARK2 co-regulated-like
  ENSP ID: ENSP00000420948
MQKSEGSGGTQLKNRATGNYDQRTSSSTQLKHRNAVQGSKSSLSTSSPESARKLHPRPSDKLNPKTINPFGEQSRVPSAFAAIYSKGGIPC

SEQ ID NO: 61305 - protein, 102 aa, Homo sapiens
  Payload ID: 12251
  Gene Symbol: PACRGL
  Gene Name: PARK2 co-regulated-like
  ENSP ID: ENSP00000421570
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRL

SEQ ID NO: 61306 - protein, 150 aa, Homo sapiens
  Payload ID: 12251
  Gene Symbol: PACRGL
  Gene Name: PARK2 co-regulated-like
  ENSP ID: ENSP00000421687
MQKSEGSGGTQLKNRATGNYDQRTSSSTQLKHRNAVQGSKSSLSTSSPESARKLHPRPSDKLNPKTINPGLRETKHPYTFVSKEGFRELLLVKGAPEKAIPLLPRLIPVLKAALVHSDDEVFERGLNALVQLSVVVGPSLNDHLKHLLTS

SEQ ID NO: 61307 - protein, 14 aa, Homo sapiens
  Payload ID: 12251
  Gene Symbol: PACRGL
  Gene Name: PARK2 co-regulated-like
  ENSP ID: ENSP00000421703
MQKSEGSGGTQLKN

SEQ ID NO: 61308 - protein, 85 aa, Homo sapiens
  Payload ID: 12251
  Gene Symbol: PACRGL
  Gene Name: PARK2 co-regulated-like
  ENSP ID: ENSP00000422142
MQKSEGSGGTQLKNRATGNYDQRTSSSTQLKHRNAVQGSKSSLSTSSPESARKLHPRPSDKLNPKTINPIGTWFSKTQITVGMSS

SEQ ID NO: 61309 - protein, 142 aa, Homo sapiens
  Payload ID: 12251
  Gene Symbol: PACRGL
  Gene Name: PARK2 co-regulated-like
  ENSP ID: ENSP00000422394
MQKSEGSGGTQLKNRATGNYDQRTSSSTQLKHRNAVQGSKSSLSTSSPESARKLHPRPSDKLNPKTINPGLRETKHPYTFVSKEGFRELLLVKGAPEKAIPLLPRLIPVLKAALVHSDDEVFERGLNALVQLSVVVGPSLND

SEQ ID NO: 61310 - protein, 203 aa, Homo sapiens
  Payload ID: 12251
  Gene Symbol: PACRGL
  Gene Name: PARK2 co-regulated-like
  ENSP ID: ENSP00000422425
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSKEGFRELLLVKGAPEKAIPLLPRLIPVLKAALVHSDDEVFERGLNALVQLSVVVGPSLNDHLKHLLTS

SEQ ID NO: 61311 - protein, 93 aa, Homo sapiens
  Payload ID: 12251
  Gene Symbol: PACRGL
  Gene Name: PARK2 co-regulated-like
  ENSP ID: ENSP00000422499
MQKSEGSGGTQLKNRATGNYDQRTSSSTQLKHRNAVQGSKSSLSTSSPESARKLHPRPSDKLNPKTINPFGEQSRVPSAFAAIYSKGGIPCRV

SEQ ID NO: 61312 - protein, 136 aa, Homo sapiens
  Payload ID: 12251
  Gene Symbol: PACRGL
  Gene Name: PARK2 co-regulated-like
  ENSP ID: ENSP00000422962
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSK

SEQ ID NO: 61313 - protein, 15 aa, Homo sapiens
  Payload ID: 12251
  Gene Symbol: PACRGL
  Gene Name: PARK2 co-regulated-like
  ENSP ID: ENSP00000423105
MWNPHIRRANCNLSL

SEQ ID NO: 61314 - protein, 221 aa, Homo sapiens; identical to SEQ ID NO: 61301
  Payload ID: 12251
  Gene Symbol: PACRGL
  Gene Name: PARK2 co-regulated-like
  Uniprot ID: Q8N7B6
  ENSP ID: ENSP00000423477

SEQ ID NO: 61315 - protein, 245 aa, Homo sapiens
  Payload ID: 12251
  Gene Symbol: PACRGL
  Gene Name: PARK2 co-regulated-like
  ENSP ID: ENSP00000423499
MWNPHIRRANCNLSLSLLQEQLFDVKEDRNLAIKFHPKLPLNWSEREAMQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSKEGFRELLLVKGAPEKAIPLLPRLIPVLKAALVHSDDEVFERGLNALVQLSVVVGPSLNDHL

SEQ ID NO: 61316 - protein, 5 aa, Homo sapiens
  Payload ID: 12251
  Gene Symbol: PACRGL
  Gene Name: PARK2 co-regulated-like
  ENSP ID: ENSP00000423523
MWNPH

SEQ ID NO: 61317 - protein, 221 aa, Homo sapiens; identical to SEQ ID NO: 61301
  Payload ID: 12251
  Gene Symbol: PACRGL
  Gene Name: PARK2 co-regulated-like
  Uniprot ID: Q8N7B6
  ENSP ID: ENSP00000423536

SEQ ID NO: 61318 - protein, 248 aa, Homo sapiens
  Payload ID: 12251
  Gene Symbol: PACRGL
  Gene Name: PARK2 co-regulated-like
  Uniprot ID: Q8N7B6
  ENSP ID: ENSP00000423881
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAEGLRETKHPYTFVSKEGFRELLLVKGAPEKAIPLLPRLIPVLKAALVHSDDEVFERGLNALVQLSVVVGPSLNDHLKHLLTSLSKRLMDKKFKEPITSALQKLEQHGGSGSLSIIKSKIPTYCSICC

SEQ ID NO: 61319 - protein, 248 aa, Homo sapiens; identical to SEQ ID NO: 61318
  Payload ID: 12251
  Gene Symbol: PACRGL
  Gene Name: PARK2 co-regulated-like
  Uniprot ID: Q8N7B6
  ENSP ID: ENSP00000423914

SEQ ID NO: 61320 - protein, 84 aa, Homo sapiens
  Payload ID: 12251
  Gene Symbol: PACRGL
  Gene Name: PARK2 co-regulated-like
  ENSP ID: ENSP00000424391
MQKSEGSGGTQLKNRATGNYDQRTSSSTQLKHRNAVQGSKSSLSTSSPESARKLHPRPSDKLNPKTINPFGEQSRVPSAFAAIY

SEQ ID NO: 61321 - protein, 105 aa, Homo sapiens
  Payload ID: 12251
  Gene Symbol: PACRGL
  Gene Name: PARK2 co-regulated-like
  ENSP ID: ENSP00000424898
MQKSEGSGGTQLKNRATGNYDQRTSSSTQLKHRNAVQGSKSSLSTSSPESARKLHPRPSDKLNPKTINPVHSDDEVFERGLNALVQLSVVVGPSLNDHLKHLLTS

SEQ ID NO: 61322 - protein, 87 aa, Homo sapiens
  Payload ID: 12251
  Gene Symbol: PACRGL
  Gene Name: PARK2 co-regulated-like
  ENSP ID: ENSP00000424950
MQKSEGSGGTQLKNRATGNYDQRTSSSTQLKHRNAVQGSKSSLSTSSPESARKLHPRPSDKLNPKTINPGSLSIIKSKIPTYCSICC

SEQ ID NO: 61323 - protein, 93 aa, Homo sapiens; identical to SEQ ID NO: 61311
  Payload ID: 12251
  Gene Symbol: PACRGL
  Gene Name: PARK2 co-regulated-like
  ENSP ID: ENSP00000425102

SEQ ID NO: 61324 - protein, 200 aa, Homo sapiens
  Payload ID: 12251
  Gene Symbol: PACRGL
  Gene Name: PARK2 co-regulated-like
  Uniprot ID: Q8N7B6
  ENSP ID: ENSP00000425461
MQKSEGSGGTQLKNRATGNYDQRTSSSTQLKHRNAVQGSKSSLSTSSPESARKLHPRPSDKLNPKTINPGLRETKHPYTFVSKEGFRELLLVKGAPEKAIPLLPRLIPVLKAALVHSDDEVFERGLNALVQLSVVVGPSLNDHLKHLLTSDPVQLMRFPRPLLGLMICQKDPWNSGKLLLAVMVSYNTQKIKIKISKGEP

SEQ ID NO: 61325 - protein, 221 aa, Homo sapiens; identical to SEQ ID NO: 61301
  Payload ID: 12251
  Gene Symbol: PACRGL
  Gene Name: PARK2 co-regulated-like
  Uniprot ID: Q8N7B6
  ENSP ID: ENSP00000425938

SEQ ID NO: 61326 - protein, 168 aa, Homo sapiens
  Payload ID: 12251
  Gene Symbol: PACRGL
  Gene Name: PARK2 co-regulated-like
  ENSP ID: ENSP00000426286
MQKSEGSGGTQLKNRATGNYDQRTSSSTQLKHRNAVQGSKSSLSTSSPESARKLHPRPSDKLNPKTINPGLRETKHPYTFVSKEGFRELLLVKGAPEKAIPLLPRLIPVLKAALVHSDDEVFERGLNALVQLSVVVGPSLNDHLKHLLTSGSLSIIKSKIPTYCSICC

SEQ ID NO: 61327 - protein, 68 aa, Homo sapiens
  Payload ID: 12251
  Gene Symbol: PACRGL
  Gene Name: PARK2 co-regulated-like
  ENSP ID: ENSP00000426399
  MOD_RES (1)..(1): Any amino acid
XFGEQSRVPSAFAAIYSKGGIPCRLVHGSVKHRLQWECPPESLSFDPLLITLAEVNMPSLEYLSENKH

SEQ ID NO: 61328 - protein, 122 aa, Homo sapiens
  Payload ID: 12251
  Gene Symbol: PACRGL
  Gene Name: PARK2 co-regulated-like
  ENSP ID: ENSP00000426643
MQKSEGSGGTQLKNRATGNYDQRTSSSTQLKHRNAVQGSKSSLSTSSPESARKLHPRPSDKLNPKTINPFGEQSRVPSAFAAIYSKGGIPCRLVHGSVKHRLQWECPPESLSFDPLLITLAE

SEQ ID NO: 61329 - protein, 79 aa, Homo sapiens
  Payload ID: 12251
  Gene Symbol: PACRGL
  Gene Name: PARK2 co-regulated-like
  ENSP ID: ENSP00000426833
MQKSEGSGGTQLKNRATGNYDQRTSSSTQLKHRNAVQGSKSSLSTSSPESARKLHPRPSDKLNPKTINPVHSDDEVFER

SEQ ID NO: 61330 - protein, 34 aa, Homo sapiens
  Payload ID: 12251
  Gene Symbol: PACRGL
  Gene Name: PARK2 co-regulated-like
  ENSP ID: ENSP00000427064
MWNPHIRRANCNLSLSLLQEQLFDVKEDRNLAIK

SEQ ID NO: 61331 - protein, 274 aa, Homo sapiens
  Payload ID: 12252
  Gene Symbol: PARK2
  Gene Name: parkin RBR E3 ubiquitin protein ligase
  Uniprot ID: O60260
  ENSP ID: ENSP00000343589
MSGECQSPHCPGTSAEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 61332 - protein, 368 aa, Homo sapiens
  Payload ID: 12252
  Gene Symbol: PARK2
  Gene Name: parkin RBR E3 ubiquitin protein ligase
  ENSP ID: ENSP00000355858
MIVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQGPSCWDDVLIPNRMSGECQSPHCPGTSAEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGYGQRRTK

SEQ ID NO: 61333 - protein, 274 aa, Homo sapiens; identical to SEQ ID NO: 61331
  Payload ID: 12252
  Gene Symbol: PARK2
  Gene Name: parkin RBR E3 ubiquitin protein ligase
  Uniprot ID: O60260
  ENSP ID: ENSP00000355860

SEQ ID NO: 61334 - protein, 316 aa, Homo sapiens
  Payload ID: 12252
  Gene Symbol: PARK2
  Gene Name: parkin RBR E3 ubiquitin protein ligase
  Uniprot ID: O60260
  ENSP ID: ENSP00000355862
MIVFVRFNSSHGFPVEVDSDTSIFQLKEVVAKRQGVPADQLRVIFAGKELRNDWTVQEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 61335 - protein, 437 aa, Homo sapiens
  Payload ID: 12252
  Gene Symbol: PARK2
  Gene Name: parkin RBR E3 ubiquitin protein ligase
  Uniprot ID: O60260
  ENSP ID: ENSP00000355863
MIVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 61336 - protein, 465 aa, Homo sapiens
  Payload ID: 12252
  Gene Symbol: PARK2
  Gene Name: parkin RBR E3 ubiquitin protein ligase
  Uniprot ID: O60260
  ENSP ID: ENSP00000355865
MIVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQGPSCWDDVLIPNRMSGECQSPHCPGTSAEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 61337 - protein, 218 aa, Homo sapiens
  Payload ID: 12252
  Gene Symbol: PARK2
  Gene Name: parkin RBR E3 ubiquitin protein ligase
  Uniprot ID: O60260
  ENSP ID: ENSP00000434414
MNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQGPSCWDDVLIPNRMSGECQSPHCPGTSAEFFFKCGAHPTSDKETSVALHLIATNSRNITCITCTDVRSPVLVFQCNSRHVICLDCFHLYCVTRLNDRQFVHDPQLGYSLPCVVCLLPGM

SEQ ID NO: 61338 - protein, 201 aa, Homo sapiens [sequence omitted]

SEQ ID NO: 61339 - protein, 74 aa, Homo sapiens [sequence omitted]

SEQ ID NO: 61340 - protein, 176 aa, Homo sapiens [sequence omitted]

SEQ ID NO: 61341 - protein, 87 aa, Homo sapiens [sequence omitted]

SEQ ID NO: 61342 - protein, 220 aa, Homo sapiens
  Payload ID: 12253
  Gene Symbol: PDDC1
  Gene Name: Parkinson disease 7 domain containing 1
  Uniprot ID: Q8NB37
  ENSP ID: ENSP00000321691
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRK

SEQ ID NO: 61343 - protein, 184 aa, Homo sapiens
  Payload ID: 12253
  Gene Symbol: PDDC1
  Gene Name: Parkinson disease 7 domain containing 1
  Uniprot ID: Q8NB37
  ENSP ID: ENSP00000346239
MASERLPNRPACLLVASGAAEGVSAQSFLHCFTMASTAFNLQVATPGGKAMEFVDVTESNARWVQDFRLKAYASPAKLESIDEPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRK

SEQ ID NO: 61344 - protein, 250 aa, Homo sapiens
  Payload ID: 12253
  Gene Symbol: PDDC1
  Gene Name: Parkinson disease 7 domain containing 1
  Uniprot ID: Q8NB37
  ENSP ID: ENSP00000380612
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSGAAASCPKADRHWQHFPVEEIFLACGFKVAGLGAAPGWGRGGKQEDRPPEEQRRAGEDFPIYQCVFIYP

SEQ ID NO: 61345 - protein, 184 aa, Homo sapiens; identical to SEQ ID NO: 61343
  Payload ID: 12253
  Gene Symbol: PDDC1
  Gene Name: Parkinson disease 7 domain containing 1
  Uniprot ID: Q8NB37
  ENSP ID: ENSP00000431183

SEQ ID NO: 61346 - protein, 186 aa, Homo sapiens
  Payload ID: 12253
  Gene Symbol: PDDC1
  Gene Name: Parkinson disease 7 domain containing 1
  ENSP ID: ENSP00000433322
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGGLGLSQEPPPRSRSPLCVSSSGPPASPACRSWWRTS

SEQ ID NO: 61347 - protein, 144 aa, Homo sapiens
  Payload ID: 12253
  Gene Symbol: PDDC1
  Gene Name: Parkinson disease 7 domain containing 1
  ENSP ID: ENSP00000434839
KLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSGLGAAPGWGRGGKQEDRPPEEQRRAGEDFPIYQCVFIYP

SEQ ID NO: 61348 - protein, 87 aa, Homo sapiens
  Payload ID: 12253
  Gene Symbol: PDDC1
  Gene Name: Parkinson disease 7 domain containing 1
  ENSP ID: ENSP00000436417
  MOD_RES (1)..(1): Any amino acid
XPSVCELVRAPGFARLPLVVEDFVKDSGACFSASEPDAVHVVLDRHLVTGQNASSTVPAVQNLLFLCGSRSSSLLPQGRPALAALSC

SEQ ID NO: 61349 - protein, 120 aa, Homo sapiens
  Payload ID: 12253
  Gene Symbol: PDDC1
  Gene Name: Parkinson disease 7 domain containing 1
  ENSP ID: ENSP00000436861
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESSR

SEQ ID NO: 61350 - protein, 162 aa, Homo sapiens
  Payload ID: 12253
  Gene Symbol: PDDC1
  Gene Name: Parkinson disease 7 domain containing 1
  ENSP ID: ENSP00000437068
WVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSGQGLGQHQAGAEEESKRTDLQKSSGGRVRISPYTSVCSSTHEE

SEQ ID NO: 61351 - protein, 189 aa, Homo sapiens
  Payload ID: 12254
  Gene Symbol: PARK7
  Gene Name: parkinson protein 7
  Uniprot ID: Q99497
  ENSP ID: ENSP00000340278
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 61352 - protein, 189 aa, Homo sapiens; identical to SEQ ID NO: 61351
  Payload ID: 12254
  Gene Symbol: PARK7
  Gene Name: parkinson protein 7
  Uniprot ID: Q99497
  ENSP ID: ENSP00000366708

SEQ ID NO: 61353 - protein, 189 aa, Homo sapiens; identical to SEQ ID NO: 61351
  Payload ID: 12254
  Gene Symbol: PARK7
  Gene Name: parkinson protein 7
  Uniprot ID: Q99497
  ENSP ID: ENSP00000366711

SEQ ID NO: 61354 - protein, 189 aa, Homo sapiens; identical to SEQ ID NO: 61351
  Payload ID: 12254
  Gene Symbol: PARK7
  Gene Name: parkinson protein 7
  Uniprot ID: Q99497
  ENSP ID: ENSP00000418770

SEQ ID NO: 61355 - protein, 189 aa, Homo sapiens; identical to SEQ ID NO: 61351
  Payload ID: 12254
  Gene Symbol: PARK7
  Gene Name: parkinson protein 7
  Uniprot ID: Q99497
  ENSP ID: ENSP00000465404

SEQ ID NO: 61356 - protein, 169 aa, Homo sapiens
  Payload ID: 12254
  Gene Symbol: PARK7
  Gene Name: parkinson protein 7
  ENSP ID: ENSP00000466242
MASKRALVILAKGAEEMETVIPVDVMRRAGIKVTVAGLAGKDPVQCSRDVVICPDASLEDAKKESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 61357 - protein, 160 aa, Homo sapiens
  Payload ID: 12254
  Gene Symbol: PARK7
  Gene Name: parkinson protein 7
  ENSP ID: ENSP00000466756
GKDPVQCSRDVVICPDASLEDAKKEGPYDVVVLPGGNLGAQNLSESAAVKEILKEQENRKGLIAAICAGPTALLAHEIGFGSKVTTHPLAKDKMMNGGCHLFCFYFAGHYTYSENRVEKDGLILTSRGPGTSFEFALAIVEALNGKEVAAQVKAPLVLKD

SEQ ID NO: 61358 - protein, 142 aa, Homo sapiens
  Payload ID: 12255
  Gene Symbol: PNKD
  Gene Name: paroxysmal nonkinesigenic dyskinesia
  Uniprot ID: Q8N490
  ENSP ID: ENSP00000248451
MAAVVAATALKGRGARNARVLRGILAGATANKASHNRTRALQSHSSPEGKEEPEPLSPELEYIPRKRGKNPMKAVGLAWAIGFPCGILLFILTKREVDKDRVKQMKARQNMRLSNTGEYESQRFRASSQSAPSPDVGSGVQT

SEQ ID NO: 61359 - protein, 361 aa, Homo sapiens
  Payload ID: 12255
  Gene Symbol: PNKD
  Gene Name: paroxysmal nonkinesigenic dyskinesia
  Uniprot ID: Q8N490
  ENSP ID: ENSP00000258362
MAWQGWPAAWQWVAGCWLLLVLVLVLLVSPRGCRARRGLRGLLMAHSQRLLFRIGYSLYTRTWLGYLFYRQQLRRARNRYPKGHSKTQPRLFNGVKVLPIPVLSDNYSYLIIDTQAQLAVAVDPSDPRAVQASIEKEGVTLVAILCTHKHWDHSGGNRDLSRRHRDCRVYGSPQDGIPYLTHPLCHQDVVSVGRLQIRALATPGHTQGHLVYLLDGEPYKGPSCLFSGDLLFLSGCGRTFEGNAETMLSSLDTVLGLGDDTLLWPGHEYAEENLGFAGVVEPENLARERKMQWVQRQRLERKGTCPSTLGEERSYNPFLRTHCLALQEALGPGPGPTGDDDYSRAQLLEELRRLKDMHKSK

SEQ ID NO: 61360 - protein, 385 aa, Homo sapiens
  Payload ID: 12255
  Gene Symbol: PNKD
  Gene Name: paroxysmal nonkinesigenic dyskinesia
  Uniprot ID: Q8N490
  ENSP ID: ENSP00000273077
MAAVVAATALKGRGARNARVLRGILAGATANKASHNRTRALQSHSSPEGKEEPEPLSPELEYIPRKRGKNPMKAVGLAWYSLYTRTWLGYLFYRQQLRRARNRYPKGHSKTQPRLFNGVKVLPIPVLSDNYSYLIIDTQAQLAVAVDPSDPRAVQASIEKEGVTLVAILCTHKHWDHSGGNRDLSRRHRDCRVYGSPQDGIPYLTHPLCHQDVVSVGRLQIRALATPGHTQGHLVYLLDGEPYKGPSCLFSGDLLFLSGCGRTFEGNAETMLSSLDTVLGLGDDTLLWPGHEYAEENLGFAGVVEPENLARERKMQWVQRQRLERKGTCPSTLGEERSYNPFLRTHCLALQEALGPGPGPTGDDDYSRAQLLEELRRLKDMHKSK

SEQ ID NO: 61361 - protein, 325 aa, Homo sapiens
  Payload ID: 12255
  Gene Symbol: PNKD
  Gene Name: paroxysmal nonkinesigenic dyskinesia
  Uniprot ID: Q8N490
  ENSP ID: ENSP00000414400
MPSSVHHTKRQMMSIYCYWYSLYTRTWLGYLFYRQQLRRARNRYPKGHSKTQPRLFNGVKVLPIPVLSDNYSYLIIDTQAQLAVAVDPSDPRAVQASIEKEGVTLVAILCTHKHWDHSGGNRDLSRRHRDCRVYGSPQDGIPYLTHPLCHQDVVSVGRLQIRALATPGHTQGHLVYLLDGEPYKGPSCLFSGDLLFLSGCGRTFEGNAETMLSSLDTVLGLGDDTLLWPGHEYAEENLGFAGVVEPENLARERKMQWVQRQRLERKGTCPSTLGEERSYNPFLRTHCLALQEALGPGPGPTGDDDYSRAQLLEELRRLKDMHKSK

SEQ ID NO: 61362 - protein, 579 aa, Homo sapiens
  Payload ID: 12256
  Gene Symbol: PARPBP
  Gene Name: PARP1 binding protein
  Uniprot ID: Q9NWS1
  ENSP ID: ENSP00000332915
MAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPSIAGGQILSVIKMQLIKGQNSRDPFCKAIEEVAQDLDLRIKNIINSQEGVVALSTTDISPARPKSHAINHGTAYCGRDTVKALLVLLDEEAANAPTKNKAELLYDEENTIHHHGTSILTLFRSPTQVNNSIKPLRERICVSMQEKKIKMKQTLIRSQFACTYKDDYMISKDNWNNVNLASKPLCVLYMENDLSEGVNPSVGRSTIGTSFGNVHLDRSKNEKVSRKSTSQTGNKSSKRKQVDLDGENILCDNRNEPPQHKNAKIPKKSNDSQNRLYGKLAKVAKSNKCTAKDKLISGQAKLTQFFRL

SEQ ID NO: 61363 - protein, 144 aa, Homo sapiens
  Payload ID: 12256
  Gene Symbol: PARPBP
  Gene Name: PARP1 binding protein
  ENSP ID: ENSP00000376641
MAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPGNFQCGEKVDRKIYP

SEQ ID NO: 61364 - protein, 498 aa, Homo sapiens
  Payload ID: 12256
  Gene Symbol: PARPBP
  Gene Name: PARP1 binding protein
  Uniprot ID: Q9NWS1
  ENSP ID: ENSP00000376643
MDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPSIAGGQILSVIKMQLIKGQNSRDPFCKAIEEVAQDLDLRIKNIINSQEGVVALSTTDISPARPKSHAINHGTAYCGRDTVKALLVLLDEEAANAPTKNKAELLYDEENTIHHHGTSILTLFRSPTQVNNSIKPLRERICVSMQEKKIKMKQTLIRSQFACTYKDDYMISKDNWNNVNLASKPLCVLYMENDLSEGVNPSVGRSTIGTSFGNVHLDRSKNEKVSRKSTSQTGNKSSKRKQVDLDGENILCDNRNEPPQHKNAKIPKKSNDSQNRLYGKLAKVAKSNKCTAKDKLISGQAKLTQFFRL

SEQ ID NO: 61365 - protein, 264 aa, Homo sapiens
  Payload ID: 12256
  Gene Symbol: PARPBP
  Gene Name: PARP1 binding protein
  ENSP ID: ENSP00000393867
ADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPRGCKSICWKINNWNEFWKCSSGQK

SEQ ID NO: 61366 - protein, 64 aa, Homo sapiens
  Payload ID: 12256
  Gene Symbol: PARPBP
  Gene Name: PARP1 binding protein
  ENSP ID: ENSP00000404323
ADSMLLALQLSMAENNKQSQLLDFLSGKQYAVGDETDLSIPTSPTSKYNRDNEKVLINCGHVFY

SEQ ID NO: 61367 - protein, 269 aa, Homo sapiens
  Payload ID: 12256
  Gene Symbol: PARPBP
  Gene Name: PARP1 binding protein
  ENSP ID: ENSP00000411313
ADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPRSPTQVNNSIKPLRERICVSMQEKKIKRV

SEQ ID NO: 61368 - protein, 656 aa, Homo sapiens
  Payload ID: 12256
  Gene Symbol: PARPBP
  Gene Name: PARP1 binding protein
  ENSP ID: ENSP00000440850
MAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPGSTIQPPSERGSLLLSRPDLLAPGEDPPVSASLTLERQKGESLLAWSWSLNFRLPGIPITVQKKRRDLKKLAAVMRQSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPSIAGGQILSVIKMQLIKGQNSRDPFCKAIEEVAQDLDLRIKNIINSQEGVVALSTTDISPARPKSHAINHGTAYCGRDTVKALLVLLDEEAANAPTKNKAELLYDEENTIHHHGTSILTLFRSPTQVNNSIKPLRERICVSMQEKKIKMKQTLIRSQFACTYKDDYMISKDNWNNVNLASKPLCVLYMENDLSEGVNPSVGRSTIGTSFGNVHLDRSKNEKVSRKSTSQTGNKSSKRKQVDLDGENILCDNRNEPPQHKNAKIPKKSNDSQNRLYGKLAKVAKSNKCTAKDKLISGQAKLTQFFRL

SEQ ID NO: 61369 - protein, 133 aa, Homo sapiens
  Payload ID: 12256
  Gene Symbol: PARPBP
  Gene Name: PARP1 binding protein
  Uniprot ID: Q9NWS1
  ENSP ID: ENSP00000442549
MAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPVSIF

SEQ ID NO: 61370 - protein, 183 aa, Homo sapiens
  Payload ID: 12256
  Gene Symbol: PARPBP
  Gene Name: PARP1 binding protein
  ENSP ID: ENSP00000444576
MAVFNQKSVSDMIKEFRKNWRALCNSERTTLCGADSMLLALQLSMAENNKQVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPRGCKSICWKINNWNEFWKCSSGQK

SEQ ID NO: 61371 - protein, 1186 aa, Homo sapiens [sequence omitted]

SEQ ID NO: 61372 - protein, 891 aa, Homo sapiens
  Payload ID: 12257
  Gene Symbol: PALB2
  Gene Name: partner and localizer of BRCA2
  ENSP ID: ENSP00000454703
MTVSTDNLLVNKAISKSGQLPTSSNLEANISCSLNELTYNNLPANENQNLKEQNQTEKSLKSPSDTLDGRNENLQESEILSQPKSLSLEATSPLSAEKHSCTVPEGLLFPAEYYVRTTRSMSNCQRKVAVEAVIQSHLDVKKKGFKNKNKDASKNLNLSNEETDQSEIRMSGTCTGQPSSRTSQKLLSLTKVSSPAGPTEDNDLSRKAVAQAPGRRYTGKRKSACTPASDHCEPLLPTSSLSIVNRSKEEVTSHKYQHEKLFIQVKGKKSRHQKEDSLSWSNSAYLSLDDDAFTAPFHRDGMLSLKQLLSFLSITDFQLPDEDFGPLKLEKVKSCSEKPVEPFESKMFGERHLKEGSCIFPEELSPKRMDTEMEDLEEDLIVLPGKSHPKRPNSQSQHTKTGLSSSILLYTPLNTVAPDDNDRPTTDMCSPAFPILGTTPAFGPQGSYEKASTEVAGRTCCTPQLAHLKDSVCLASDTKQFDSSGSPAKPHTTLQVSGRQGQPTCDCDSVPPGTPPPIESFTFKENQLCRNTCQELHKHSVEQTETAELPASDSINPGNLQLVSELKNPSGSCSVDVSAMFWERAGCKEPCIITACEDVVSLWKALDAWQWEKLYTWHFAEVPVLQIVPVPDVYNLVCVALGNLEIREIRALFCSSDDESEKQVLLKSGNIKAVLGLTKRRLVSSSGTLSDQQVEVMTFAEDGGGKENQFLMPPEETILTFAEVQGMQEALLGTTIMNNIVIWNLKTGQLLKKMHIDDSYQASVCHKAYSEMGLLFIVLSHPCAKESESLRSPVFQLIVINPKTTLSVGVMLYCLPPGQAGRFLEGDVKDHCAAAILTSGTIAIWDLLLGQCTALLPPVSDQHWSFVKWSGTDSHLLAGQKDGNIFVYHYS

SEQ ID NO: 61373 - protein, 43 aa, Homo sapiens
  Payload ID: 12257
  Gene Symbol: PALB2
  Gene Name: partner and localizer of BRCA2
  ENSP ID: ENSP00000459237
  MOD_RES (1)..(1): Any amino acid
XTIMNNIVIWNLKTGQLLKKMHIDDSYQASVCHKAYSEMVPGR

SEQ ID NO: 61374 - protein, 30 aa, Homo sapiens
  Payload ID: 12257
  Gene Symbol: PALB2
  Gene Name: partner and localizer of BRCA2
  ENSP ID: ENSP00000459882
  MOD_RES (1)..(1): Any amino acid
XKIKHSIKKTVEEQDCLSQQDLSPQLKHSD

SEQ ID NO: 61375 - protein, 89 aa, Homo sapiens
  Payload ID: 12257
  Gene Symbol: PALB2
  Gene Name: partner and localizer of BRCA2
  ENSP ID: ENSP00000460666
MFPACADVILILAYLLVELKEKLAFLKREYSKTLARLQRAQRAEKIKHSIKKTVEEQDCLSQQDLSPQLKHSEPKNKICVYDKLHIKTH

SEQ ID NO: 61376 - protein, 252 aa, Homo sapiens
  Payload ID: 12258
  Gene Symbol: PNO1
  Gene Name: partner of NOB1 homolog
  Uniprot ID: Q9NRX1
  ENSP ID: ENSP00000263657
MESEMETQSARAEEGFTQVTRKGGRRAKKRQAEQLSAAGEGGDAGRMDTEEARPAKRPVFPPLCGDGLLSGKEETRKIPVPANRYTPLKENWMKIFTPIVEHLGLQIRFNLKSRNVEIRTCKETKDVSALTKAADFVKAFILGFQVEDALALIRLDDLFLESFEITDVKPLKGDHLSRAIGRIAGKGGKTKFTIENVTRTRIVLADVKVHILGSFQNIKMARTAICNLILGNPPSKVYGNIRAVASRSADRF

SEQ ID NO: 61377 - protein, 136 aa, Homo sapiens
  Payload ID: 12258
  Gene Symbol: PNO1
  Gene Name: partner of NOB1 homolog
  ENSP ID: ENSP00000405892
MESEMETQSARAEEGFTQVTRKGGRRAKKRQAEQLSAAGEGGDAGRMDTEEARPAKRPVFPPLCGDGLLSGKEETRKIPVPANRYTPLKENWMKIFTPIVEHLGLQIRFNLKSRNVEIRCMQVVRPGAVGLRNISI

SEQ ID NO: 61378 - protein, 110 aa, Homo sapiens
  Payload ID: 12259
  Gene Symbol: PVALB
  Gene Name: parvalbumin
  Uniprot ID: P20472
  ENSP ID: ENSP00000216200
MSMTDLLNAEDIKKAVGAFSATDSFDHKKFFQMVGLKKKSADDVKKVFHMLDKDKSGFIEEDELGFILKGFSPDARDLSAKETKMLMAAGDKDGDGKIGVDEFSTLVAES

SEQ ID NO: 61379 - protein, 106 aa, Homo sapiens
  Payload ID: 12259
  Gene Symbol: PVALB
  Gene Name: parvalbumin
  ENSP ID: ENSP00000384735
  MOD_RES (1)..(1): Any amino acid
XMTDLLNAEDIKKAVGAFSATDSFDHKKFFQMVGLKKKSADDVKKVFHMLDKDKSGFIEEDELGFILKGFSPDARDLSAKETKMLMAAGDKDGDGKIGVDDPADVD

SEQ ID NO: 61380 - protein, 78 aa, Homo sapiens
  Payload ID: 12259
  Gene Symbol: PVALB
  Gene Name: parvalbumin
  ENSP ID: ENSP00000386089
MVGLKKKSADDVKKVFHMLDKDKSGFIEEDELGFILKGFSPDARDLSAKETKMLMAAGDKDGDGKIGVDEFSTLVAES

SEQ ID NO: 61381 - protein, 110 aa, Homo sapiens; identical to SEQ ID NO: 61378
  Payload ID: 12259
  Gene Symbol: PVALB
  Gene Name: parvalbumin
  Uniprot ID: P20472
  ENSP ID: ENSP00000400247

SEQ ID NO: 61382 - protein, 101 aa, Homo sapiens
  Payload ID: 12259
  Gene Symbol: PVALB
  Gene Name: parvalbumin
  ENSP ID: ENSP00000406977
MSMTDLLNAEDIKKAVGAFSATDSFDHKKFFQMVGLKKKSADDVKKVFHMLDKDKSGFIEEDELGFILKGFSPDARDLSAKETKMLMAAGDKDGDGKIGVD

SEQ ID NO: 61383 - protein, 110 aa, Homo sapiens; identical to SEQ ID NO: 61378
  Payload ID: 12259
  Gene Symbol: PVALB
  Gene Name: parvalbumin
  Uniprot ID: P20472
  ENSP ID: ENSP00000480913

SEQ ID NO: 61384 - protein, 78 aa, Homo sapiens; identical to SEQ ID NO: 61380
  Payload ID: 12259
  Gene Symbol: PVALB
  Gene Name: parvalbumin
  ENSP ID: ENSP00000485850

SEQ ID NO: 61385 - protein, 110 aa, Homo sapiens; identical to SEQ ID NO: 61378
  Payload ID: 12259
  Gene Symbol: PVALB
  Gene Name: parvalbumin
  Uniprot ID: P20472
  ENSP ID: ENSP00000486144

SEQ ID NO: 61386 - protein, 101 aa, Homo sapiens; identical to SEQ ID NO: 61382
  Payload ID: 12259
  Gene Symbol: PVALB
  Gene Name: parvalbumin
  ENSP ID: ENSP00000487336

SEQ ID NO: 61387 - protein, 106 aa, Homo sapiens; identical to SEQ ID NO: 61379
  Payload ID: 12259
  Gene Symbol: PVALB
  Gene Name: parvalbumin
  ENSP ID: ENSP00000487426
  MOD_RES (1)..(1): Any amino acid

SEQ ID NO: 61388 - protein, 412 aa, Homo sapiens
  Payload ID: 12260
  Gene Symbol: PARVA
  Gene Name: parvin, alpha
  ENSP ID: ENSP00000334008
MLGIIPLPFGKPQPQSRRRPLRPPSASSASRPARGSLRRAMATSPQKSPSVPKSPTPKSPPSRKKDDSFLGKLGGTLARRKKAKEVSELQEEGMNAINLPLSPIPFELDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRHERDAFDTLFDHAPDKLNVVKKTLITFVNKHLNKLNLEVTELETQFADGVYLVLLMGLLEGYFVPLHSFFLTPDSFEQKVLNVSFAFELMQDGGLEKPKPRPEDIVNCDLKSTLRVLYNLFTKYRNVE

SEQ ID NO: 61389 - protein, 209 aa, Homo sapiens
  Payload ID: 12260
  Gene Symbol: PARVA
  Gene Name: parvin, alpha
  ENSP ID: ENSP00000435860
MGCGALCPQVSELQEEGMNAINLPLSPIPFELDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRH

SEQ ID NO: 61390 - protein, 364 aa, Homo sapiens
  Payload ID: 12261
  Gene Symbol: PARVB
  Gene Name: parvin, beta
  Uniprot ID: Q9HBI1
  ENSP ID: ENSP00000342492
MSSAPRSPTPRPRRMKKDESFLGKLGGTLARKRRAREVSDLQEEGKNAINSPMSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 61391 - protein, 327 aa, Homo sapiens
  Payload ID: 12261
  Gene Symbol: PARVB
  Gene Name: parvin, beta
  Uniprot ID: Q9HBI1
  ENSP ID: ENSP00000384353
MSDLQEEGKNAINSPMSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 61392 - protein, 397 aa, Homo sapiens
  Payload ID: 12261
  Gene Symbol: PARVB
  Gene Name: parvin, beta
  Uniprot ID: Q9HBI1
  ENSP ID: ENSP00000384515
MHHVFKDHQRGEKRGFLSPENKNCRRLELRRGCSCSWGLCSQALMASLAGSLLPGSDRSGVETSEYAQGGVSDLQEEGKNAINSPMSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 61393 - protein, 194 aa, Homo sapiens
  Payload ID: 12261
  Gene Symbol: PARVB
  Gene Name: parvin, beta
  ENSP ID: ENSP00000393758
MPRLKCSGAVIAHCSLELLASSDPSASASQGARTTVSDLQEEGKNAINSPMSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAP

SEQ ID NO: 61394 - protein, 289 aa, Homo sapiens
  Payload ID: 12261
  Gene Symbol: PARVB
  Gene Name: parvin, beta
  ENSP ID: ENSP00000482511
MSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 61395 - protein, 187 aa, Homo sapiens
  Payload ID: 12262
  Gene Symbol: PARVG
  Gene Name: parvin, gamma
  Uniprot ID: Q9HBI0
  ENSP ID: ENSP00000349378
MEPEFLYDLLQLPKGVEPPAEEELSKGGKKKYLPPTSRKDPKFEELQKVLMEWINATLLPEHIVVRSLEEDMFDGLILHHLFQRLAALKLEAEDIALTATSQKHKLTVVLEAVNRSLQLEEWQAKWSVESIFNKDLLSTLHLLVALAKRFQPDLSLPTNVQVEVITIESTKSGLKSEKLVEQLTEYR

SEQ ID NO: 61396 - protein, 331 aa, Homo sapiens
  Payload ID: 12262
  Gene Symbol: PARVG
  Gene Name: parvin, gamma
  Uniprot ID: Q9HBI0
  ENSP ID: ENSP00000391453
MEPEFLYDLLQLPKGVEPPAEEELSKGGKKKYLPPTSRKDPKFEELQKVLMEWINATLLPEHIVVRSLEEDMFDGLILHHLFQRLAALKLEAEDIALTATSQKHKLTVVLEAVNRSLQLEEWQAKWSVESIFNKDLLSTLHLLVALAKRFQPDLSLPTNVQVEVITIESTKSGLKSEKLVEQLTEYSTDKDEPPKDVFDELFKLAPEKVNAVKEAIVNFVNQKLDRLGLSVQNLDTQFADGVILLLLIGQLEGFFLHLKEFYLTPNSPAEMLHNVTLALELLKDEGLLSCPVSPEDIVNKDAKSTLRVLYGLFCKHTQKAHRDRTPHGAPN

SEQ ID NO: 61397 - protein, 331 aa, Homo sapiens; identical to SEQ ID NO: 61396
  Payload ID: 12262
  Gene Symbol: PARVG
  Gene Name: parvin, gamma
  Uniprot ID: Q9HBI0
  ENSP ID: ENSP00000391583

SEQ ID NO: 61398 - protein, 26 aa, Homo sapiens
  Payload ID: 12262
  Gene Symbol: PARVG
  Gene Name: parvin, gamma
  ENSP ID: ENSP00000399839
MEPEFLYDLLQLPKGVEPPAEEELSK

SEQ ID NO: 61399 - protein, 30 aa, Homo sapiens
  Payload ID: 12262
  Gene Symbol: PARVG
  Gene Name: parvin, gamma
  ENSP ID: ENSP00000407199
MEPEFLYDLLQLPKGVEPPAEEELSKGVCP

SEQ ID NO: 61400 - protein, 187 aa, Homo sapiens; identical to SEQ ID NO: 61395
  Payload ID: 12262
  Gene Symbol: PARVG
  Gene Name: parvin, gamma
  Uniprot ID: Q9HBI0
  ENSP ID: ENSP00000416761

SEQ ID NO: 61401 - protein, 34 aa, Homo sapiens
  Payload ID: 12262
  Gene Symbol: PARVG
  Gene Name: parvin, gamma
  ENSP ID: ENSP00000475593
MEPEFLYDLLQLPKGVEPPAEEELSKELEPLLSR

SEQ ID NO: 61402 - protein, 773 aa, Homo sapiens
  Payload ID: 12263
  Gene Symbol: PASD1
  Gene Name: PAS domain containing 1
  Uniprot ID: Q8IV76
  ENSP ID: ENSP00000359382
MKMRGEKRRDKVNPKSSQRKLNWIPSFPTYDYFNQVTLQLLDGFMITLSTDGVIICVAENISSLLGHLPAEIVGKKLLSLLPDEEKDEVYQKIILKFPLLNSETHIEFCCHLKRGNVEHGDSSAYENVKFIVNVRDICNEFPVVFSGLFSSHLCADFAACVPQEDRLYLVGNVCILRTQLLQQLYTSKAVSDEAVLTQDSDEEPFVGELSSSQGQRGHTSMKAVYVEPAAAAAAAAISDDQIDIAEVEQYGPQENVHMFVDSDSTYCSSTVFLDTMPESPALSLQDFRGEPEVNPLYRADPVDLEFSVDQVDSVDQEGPMDQQDPENPVAPLDQAGLMDPVDPEDSVDLGAAGASAQPLQPSSPVAYDIISQELELMKKLKEQLEERTWLLHDAIQNQQNALELMMDHLQKQPNTLRHVVIPDLQSSEAVPKKQQKQHAGQVKRPLPHPKDVKCFCGLSLSNSLKNTGELQEPCVAFNQQQLVQQEQHLKEQQRQLREQLQQLREQRKVQKQKKMQEKKKLQEQKMQEKKKLQEQRRQKKKKLQERKKWQGQMLQKEPEEEQQKQQLQEQPLKHNVIVGNERVQICLQNPRDVSVPLCNHPVRFLQAQPIVPVQRAAEQQPSGFYQDENCGQQEDESQSFYPEAYQGPPVNQLPLIDTSNSEAISSSSIPQFPITSDSTISTLETPQDYIRLWQELSDSLGPVVQVNTWSCDEQGTLHGQPTYHQVQVSEVGVEGPPDPQAFQGPAAYQPDQMRSAEQTRLMPAEQRDSNKPC

SEQ ID NO: 61403 - protein, 1323 aa, Homo sapiens
  Payload ID: 12264
  Gene Symbol: PASK
  Gene Name: PAS domain containing serine/threonine kinase
  Uniprot ID: Q96RG2
  ENSP ID: ENSP00000234040
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPAPVCNPNKAIFTVDAKTTEILVANDKACGLLGYSSQDLIGQKLTQFFLRSDSDVVEALSEEHMEADGHAAVVFGTVVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQLVSAVGYLRLKDIIHRDIKDENIVIAEDFTIKLIDFGSAAYLERGKLFYTFCGTIEYCAPEVLMGNPYRGPELEMWSLGVTLYTLVFEENPFCELEETVEAAIHPPYLVSKELMSLVSGLLQPVPERRTTLEKLVTDPWVTQPVNLADYTWEEVFRVNKPESGVLSAASLEMGNRSLSDVAQAQELCGGPVPGEAPNGQGCLHPGDPRLLTS

SEQ ID NO: 61404 - protein, 1330 aa, Homo sapiens
  Payload ID: 12264
  Gene Symbol: PASK
  Gene Name: PAS domain containing serine/threonine kinase
  Uniprot ID: Q96RG2
  ENSP ID: ENSP00000351475
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPAPVCNPNKAIFTVDAKTTEILVANDKACGLLGYSSQDLIGQKLTQFFLRSDSDVVEALSEEHMEADGHAAVVFGTVVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQVRAGQSRLVSAVGYLRLKDIIHRDIKDENIVIAEDFTIKLIDFGSAAYLERGKLFYTFCGTIEYCAPEVLMGNPYRGPELEMWSLGVTLYTLVFEENPFCELEETVEAAIHPPYLVSKELMSLVSGLLQPVPERRTTLEKLVTDPWVTQPVNLADYTWEEVFRVNKPESGVLSAASLEMGNRSLSDVAQAQELCGGPVPGEAPNGQGCLHPGDPRLLTS

SEQ ID NO: 61405 - protein, 1323 aa, Homo sapiens; identical to SEQ ID NO: 61403
  Payload ID: 12264
  Gene Symbol: PASK
  Gene Name: PAS domain containing serine/threonine kinase
  Uniprot ID: Q96RG2
  ENSP ID: ENSP00000384016

SEQ ID NO: 61406 - protein, 1143 aa, Homo sapiens
  Payload ID: 12264
  Gene Symbol: PASK
  Gene Name: PAS domain containing serine/threonine kinase
  Uniprot ID: Q96RG2
  ENSP ID: ENSP00000384438
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPAPVCNPNKAIFTVDAKTTEILVANDKACGLLGYSSQDLIGQKLTQFFLRSDSDVVEALSEEHMEADGHAAVVFGTVVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQVRAGQSRVSVNAGLGAWVRWLQRSVIHTRFSL

SEQ ID NO: 61407 - protein, 193 aa, Homo sapiens
  Payload ID: 12264
  Gene Symbol: PASK
  Gene Name: PAS domain containing serine/threonine kinase
  ENSP ID: ENSP00000395672
  MOD_RES (1)..(1): Any amino acid
XMFCSPAGQHIRCSRVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLG

SEQ ID NO: 61408 - protein, 125 aa, Homo sapiens
  Payload ID: 12264
  Gene Symbol: PASK
  Gene Name: PAS domain containing serine/threonine kinase
  ENSP ID: ENSP00000397922
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPA

SEQ ID NO: 61409 - protein, 140 aa, Homo sapiens
  Payload ID: 12264
  Gene Symbol: PASK
  Gene Name: PAS domain containing serine/threonine kinase
  ENSP ID: ENSP00000400734
MKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGT

SEQ ID NO: 61410 - protein, 71 aa, Homo sapiens
  Payload ID: 12264
  Gene Symbol: PASK
  Gene Name: PAS domain containing serine/threonine kinase
  ENSP ID: ENSP00000408506
MEDGGLTAFEEDQRCLSQSLPLPVSAEGPAAQTTAEPSRSFSSAHRHLSRRNGLSRLCQSRTALSGGHHQP

SEQ ID NO: 61411 - protein, 1323 aa, Homo sapiens; identical to SEQ ID NO: 61403
  Payload ID: 12264
  Gene Symbol: PASK
  Gene Name: PAS domain containing serine/threonine kinase
  Uniprot ID: Q96RG2
  ENSP ID: ENSP00000441374

SEQ ID NO: 61412 - protein, 71 aa, Homo sapiens; identical to SEQ ID NO: 61410
  Payload ID: 12264
  Gene Symbol: PASK
  Gene Name: PAS domain containing serine/threonine kinase
  ENSP ID: ENSP00000486149

SEQ ID NO: 61413 - protein, 446 aa, Homo sapiens
  Payload ID: 12265
  Gene Symbol: PNPLA1
  Gene Name: patatin-like phospholipase domain containing 1
  Uniprot ID: Q8N8W4
  ENSP ID: ENSP00000321116
MVQMMRQFLYRVLPEDSYKVTTGKLHVSLTRLTDGENVVVSEFTSKEELIEALYCSCFVPVYCGLIPPTYRGVWAFLTLPPQRYIDGGFTGMQPCAFWTDAITISTFSGQQDICPRDCPAIFHDFRMFNCSFQFSLENIARMTHALFPPDLVILHDYYYRGYEDAVLYLRRLNAVYLNSSSKRVIFPRVEVYCQIELALGNECPERSQPSLRARQASLEGATQPHKEWVPKGDGRGSHGPPVSQPVQTLEFTCESPVSAPVSPLEQPPAQPLASSTPLSLSGMPPVSFPAVHKPPSSTPGSSLPTPPPGLSPLSPQQQVQPSGSPARSLHSQAPTSPRPSLGPSTVGAPQTLPRSSLSAFPAQPPVEELGQEQPQAVALLVSSKPKSAVPLVHVKETVSKPYVTESPAEDSNWVNKVFKKNKQKTSGTRKGFPRHSGSKKPSSKVQ

SEQ ID NO: 61414 - protein, 437 aa, Homo sapiens
  Payload ID: 12265
  Gene Symbol: PNPLA1
  Gene Name: patatin-like phospholipase domain containing 1
  Uniprot ID: Q8N8W4
  ENSP ID: ENSP00000373367
MVQMMRQFLYRVLPEDSYKVTTGKLHVSLTRLTDGENVVVSEFTSKEELIEALYCSCFVPVYCGLIPPTYRGVRYIDGGFTGMQPCAFWTDAITISTFSGQQDICPRDCPAIFHDFRMFNCSFQFSLENIARMTHALFPPDLVILHDYYYRGYEDAVLYLRRLNAVYLNSSSKRVIFPRVEVYCQIELALGNECPERSQPSLRARQASLEGATQPHKEWVPKGDGRGSHGPPVSQPVQTLEFTCESPVSAPVSPLEQPPAQPLASSTPLSLSGMPPVSFPAVHKPPSSTPGSSLPTPPPGLSPLSPQQQVQPSGSPARSLHSQAPTSPRPSLGPSTVGAPQTLPRSSLSAFPAQPPVEELGQEQPQAVALLVSSKPKSAVPLVHVKETVSKPYVTESPAEDSNWVNKVFKKNKQKTSGTRKGFPRHSGSKKPSSKVQ

SEQ ID NO: 61415 - protein, 532 aa, Homo sapiens
  Payload ID: 12265
  Gene Symbol: PNPLA1
  Gene Name: patatin-like phospholipase domain containing 1
  Uniprot ID: Q8N8W4
  ENSP ID: ENSP00000378072
MEEQVFKGDPDTPHSISFSGSGFLSFYQAGAVDALRDLAPRMLETAHRFAGTSAGAVIAALAICGIEMDEYLRVLNVGVAEVKKSFLGPLSPSCKMVQMMRQFLYRVLPEDSYKVTTGKLHVSLTRLTDGENVVVSEFTSKEELIEALYCSCFVPVYCGLIPPTYRGVRYIDGGFTGMQPCAFWTDAITISTFSGQQDICPRDCPAIFHDFRMFNCSFQFSLENIARMTHALFPPDLVILHDYYYRGYEDAVLYLRRLNAVYLNSSSKRVIFPRVEVYCQIELALGNECPERSQPSLRARQASLEGATQPHKEWVPKGDGRGSHGPPVSQPVQTLEFTCESPVSAPVSPLEQPPAQPLASSTPLSLSGMPPVSFPAVHKPPSSTPGSSLPTPPPGLSPLSPQQQVQPSGSPARSLHSQAPTSPRPSLGPSTVGAPQTLPRSSLSAFPAQPPVEELGQEQPQAVALLVSSKPKSAVPLVHVKETVSKPYVTESPAEDSNWVNKVFKKNKQKTSGTRKGFPRHSGSKKPSSKVQ

SEQ ID NO: 61416 - protein, 533 aa, Homo sapiens
  Payload ID: 12265
  Gene Symbol: PNPLA1
  Gene Name: patatin-like phospholipase domain containing 1
  ENSP ID: ENSP00000391868
MEEQVFKGDPDTPHSISFSGSGFLSFYQAGAVDALRDLAPRMLETAHRFAGTSAGAVIAALAICGIEMDEYLRVLNVGVAEVKKSFLGPLSPSCKMVQMMRQFLYRVLPEDSYKVTTGKLHVSLTRLTDGENVVVSEFTSKEELIEAALYCSCFVPVYCGLIPPTYRGVRYIDGGFTGMQPCAFWTDAITISTFSGQQDICPRDCPAIFHDFRMFNCSFQFSLENIARMTHALFPPDLVILHDYYYRGYEDAVLYLRRLNAVYLNSSSKRVIFPRVEVYCQIELALGNECPERSQPSLRARQASLEGATQPHKEWVPKGDGRGSHGPPVSQPVQTLEFTCESPVSAPVSPLEQPPAQPLASSTPLSLSGMPPVSFPAVHKPPSSTPGSSLPTPPPGLSPLSPQQQVQPSGSPARSLHSQAPTSPRPSLGPSTVGAPQTLPRSSLSAFPAQPPVEELGQEQPQAVALLVSSKPKSAVPLVHVKETVSKPYVTESPAEDSNWVNKVFKKNKQKTSGTRKGFPRHSGSKKPSSKVQ

SEQ ID NO: 61417 - protein, 504 aa, Homo sapiens
  Payload ID: 12266
  Gene Symbol: PNPLA2
  Gene Name: patatin-like phospholipase domain containing 2
  Uniprot ID: Q96AD5
  ENSP ID: ENSP00000337701
MFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVRYVDGGISDNLPLYELKNTITVSPFSGESDICPQDSSTNIHELRVTNTSIQFNLRNLYRLSKALFPPEPLVLREMCKQGYRDGLRFLQRNGLLNRPNPLLALPPARPHGPEDKDQAVESAQAEDYSQLPGEDHILEHLPARLNEALLEACVEPTDLLTTLSNMLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQLAGPAPLLSTPAPEARPVIGALGL

SEQ ID NO: 61418 - protein, 215 aa, Homo sapiens
  Payload ID: 12266
  Gene Symbol: PNPLA2
  Gene Name: patatin-like phospholipase domain containing 2
  ENSP ID: ENSP00000481602
MVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQLAGPAPLLSTPAPEARPVIGPGAVRPRPSRGTLPETPPLPLRSEMRGLTVAKRGLCRGPPRQPLTSCMH

SEQ ID NO: 61419 - protein, 481 aa, Homo sapiens
  Payload ID: 12267
  Gene Symbol: PNPLA3
  Gene Name: patatin-like phospholipase domain containing 3
  Uniprot ID: Q9NST1
  ENSP ID: ENSP00000216180
MYDAERGWSLSFAGCGFLGFYHVGATRCLSEHAPHLLRDARMLFGASAGALHCVGVLSGIPLEQTLQVLSDLVRKARSRNIGIFHPSFNLSKFLRQGLCKCLPANVHQLISGKIGISLTRVSDGENVLVSDFRSKDEVVDALVCSCFIPFYSGLIPPSFRGVRYVDGGVSDNVPFIDAKTTITVSPFYGEYDICPKVKSTNFLHVDITKLSLRLCTGNLYLLSRAFVPPDLKVLGEICLRGYLDAFRFLEEKGICNRPQPGLKSSSEGMDPEVAMPSWANMSLDSSPESAALAVRLEGDELLDHLRLSILPWDESILDTLSPRLATALSEEMKDKGGYMSKICNLLPIRIMSYVMLPCTLPVESAIAIVQRLVTWLPDMPDDVLWLQWVTSQVFTRVLMCLLPASRSQMPVSSQQASPCTPEQDWPCWTPCSPKGCPAETKAEATPRSILRSSLNFFLGNKVPAGAEGLSTFPSFSLEKSL

SEQ ID NO: 61420 - protein, 120 aa, Homo sapiens
  Payload ID: 12267
  Gene Symbol: PNPLA3
  Gene Name: patatin-like phospholipase domain containing 3
  ENSP ID: ENSP00000384668
MYDAERGWSLSFAGCGFLGFYHVGATRCLSEHAPHLLRDARMLFGASAGALHCVGVLSGIPLDSAGPLRSCAEGQESEHWHLPSILQLKQVPPTGSLQMPPGQCPPAHLRQNRHLSYQSV

SEQ ID NO: 61421 - protein, 477 aa, Homo sapiens
  Payload ID: 12267
  Gene Symbol: PNPLA3
  Gene Name: patatin-like phospholipase domain containing 3
  Uniprot ID: Q9NST1
  ENSP ID: ENSP00000397987
MYDAERGWSLSFAGCGFLGFYHVGATRCLSEHAPHLLRDARMLFGASAGALHCVGVLSEQTLQVLSDLVRKARSRNIGIFHPSFNLSKFLRQGLCKCLPANVHQLISGKIGISLTRVSDGENVLVSDFRSKDEVVDALVCSCFIPFYSGLIPPSFRGVRYVDGGVSDNVPFIDAKTTITVSPFYGEYDICPKVKSTNFLHVDITKLSLRLCTGNLYLLSRAFVPPDLKVLGEICLRGYLDAFRFLEEKGICNRPQPGLKSSSEGMDPEVAMPSWANMSLDSSPESAALAVRLEGDELLDHLRLSILPWDESILDTLSPRLATALSEEMKDKGGYMSKICNLLPIRIMSYVMLPCTLPVESAIAIVQRLVTWLPDMPDDVLWLQWVTSQVFTRVLMCLLPASRSQMPVSSQQASPCTPEQDWPCWTPCSPKGCPAETKAEATPRSILRSSLNFFLGNKVPAGAEGLSTFPSFSLEKSL

SEQ ID NO: 61422 - protein, 253 aa, Homo sapiens
  Payload ID: 12268
  Gene Symbol: PNPLA4
  Gene Name: patatin-like phospholipase domain containing 4
  Uniprot ID: P41247
  ENSP ID: ENSP00000370430
MKHINLSFAACGFLGIYHLGAASALCRHGKKLVKDVKAFAGASAGSLVASVLLTAPEKIEECNQFTYKFAEEIRRQSFGAVTPGYDFMARLRSGMESILPPSAHELAQNRLHVSITNAKTRENHLVSTFSSREDLIKVLLASSFVPIYAGLKLVEYKGQKWVDGGLTNALPILPVGRTVTISPFSGRLDISPQDKGQLDLYVNIAKQDIMLSLANLVRLNQALFPPSKRKMESLYQCGFDDTVKFLLKENWFE

SEQ ID NO: 61423 - protein, 190 aa, Homo sapiens
  Payload ID: 12268
  Gene Symbol: PNPLA4
  Gene Name: patatin-like phospholipase domain containing 4
  ENSP ID: ENSP00000406698
MKHINLSFAACGFLGIYHLGAASALCRHGKKLVKDVKAFAGASAGSLVASVLLTAPEKIEECNQFTYKFAEEIRRQSFGAVTPGYDFMARLRSGMESILPPSAHELAQNRLHVSITNAKTRENHLVSTFSSREDLIKVLLASSFVPIYAGLKLVEYKGQKWVDGGLTNALPILPVGRTVTISPFSGRLDI

SEQ ID NO: 61424 - protein, 253 aa, Homo sapiens; identical to SEQ ID NO: 61422
  Payload ID: 12268
  Gene Symbol: PNPLA4
  Gene Name: patatin-like phospholipase domain containing 4
  Uniprot ID: P41247
  ENSP ID: ENSP00000415245

SEQ ID NO: 61425 - protein, 166 aa, Homo sapiens
  Payload ID: 12268
  Gene Symbol: PNPLA4
  Gene Name: patatin-like phospholipase domain containing 4
  Uniprot ID: P41247
  ENSP ID: ENSP00000443157
MARLRSGMESILPPSAHELAQNRLHVSITNAKTRENHLVSTFSSREDLIKVLLASSFVPIYAGLKLVEYKGQKWVDGGLTNALPILPVGRTVTISPFSGRLDISPQDKGQLDLYVNIAKQDIMLSLANLVRLNQALFPPSKRKMESLYQCGFDDTVKFLLKENWFE

SEQ ID NO: 61426 - protein, 429 aa, Homo sapiens
  Payload ID: 12269
  Gene Symbol: PNPLA5
  Gene Name: patatin-like phospholipase domain containing 5
  Uniprot ID: Q7Z6Z6
  ENSP ID: ENSP00000216177
MGFLEEEGRWNLSFSGAGYLGAHHVGATECLRQRAPRLLQGARRIYGSSSGALNAVSIVCGKSVDFCCSHLLGMVGQLERLSLSILHPAYAPIEHVKQQLQDALPPDAHVLASQRLGISLTRWPDGRNFLVTDFATCDELIQALVCTLYFPFYCGLIPPEFRGERYIDGALSNNLPFADCPSTITVSPFHGTVDICPQSTSPNLHELNVFNFSFQISTENFFLGLICLIPPSLEVVADNCRQGYLDALRFLERRGLTKEPVLWTLVSKEPPAPADGNWDAGCDQRWKGGLSLNWKVPHVQVKDVPNFEQLSPELEAALKKACTRDPSRWARFWHSGPGQVLTYLLLPCTLPFEYIYFRSRRLVVWLPDVPADLWWMQGLLRNMALEVFSRTKAQLLGPISPPATRVLETSPLQPQIAPHREELGPTHQA

SEQ ID NO: 61427 - protein, 315 aa, Homo sapiens
  Payload ID: 12269
  Gene Symbol: PNPLA5
  Gene Name: patatin-like phospholipase domain containing 5
  Uniprot ID: Q7Z6Z6
  ENSP ID: ENSP00000370595
MGFLEEEGRWNLSFSGAGYLGAHHVGATECLRQRAPRLLQGARRIYGSSSGALNAVSIVCGKSVDCPSTITVSPFHGTVDICPQSTSPNLHELNVFNFSFQISTENFFLGLICLIPPSLEVVADNCRQGYLDALRFLERRGLTKEPVLWTLVSKEPPAPADGNWDAGCDQRWKGGLSLNWKVPHVQVKDVPNFEQLSPELEAALKKACTRDPSRWARFWHSGPGQVLTYLLLPCTLPFEYIYFRSRRLVVWLPDVPADLWWMQGLLRNMALEVFSRTKAQLLGPISPPATRVLETSPLQPQIAPHREELGPTHQA

SEQ ID NO: 61428 - protein, 268 aa, Homo sapiens
  Payload ID: 12269
  Gene Symbol: PNPLA5
  Gene Name: patatin-like phospholipase domain containing 5
  ENSP ID: ENSP00000405732
MGFLEEEGRWNLSFSGAGYLGAHHVGATECLRQRAPRLLQGARRIYGSSSGALNAVSIVCGKSVDFCCSHLLGMVGQLERLSLSILHPAYAPIEHVKQQLQDALPPDAHVLASQRLGISLTRWPDGRNFLVTDFATCDELIQVVADNCRQGYLDALRFLERRGLTKEPVLWTLVSKEPPAPADGNWDAGCDQRWKGGLSLNWKVPHVQVKDVPNFEQLSPELEAALKKACTRDPSRWARFWHSGPGQVLTYLLLPCTLPFEYIYFRSR

SEQ ID NO: 61429 - protein, 429 aa, Homo sapiens; identical to SEQ ID NO: 61426
  Payload ID: 12269
  Gene Symbol: PNPLA5
  Gene Name: patatin-like phospholipase domain containing 5
  Uniprot ID: Q7Z6Z6
  ENSP ID: ENSP00000471069

SEQ ID NO: 61430 - protein, 315 aa, Homo sapiens; identical to SEQ ID NO: 61427
  Payload ID: 12269
  Gene Symbol: PNPLA5
  Gene Name: patatin-like phospholipase domain containing 5
  Uniprot ID: Q7Z6Z6
  ENSP ID: ENSP00000471795

SEQ ID NO: 61431 - protein, 1327 aa, Homo sapiens
  Payload ID: 12270
  Gene Symbol: PNPLA6
  Gene Name: patatin-like phospholipase domain containing 6
  Uniprot ID: Q8IY17
  ENSP ID: ENSP00000221249
MEAPLQTGMVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 61432 - protein, 1327 aa, Homo sapiens; identical to SEQ ID NO: 61431
  Payload ID: 12270
  Gene Symbol: PNPLA6
  Gene Name: patatin-like phospholipase domain containing 6
  Uniprot ID: Q8IY17
  ENSP ID: ENSP00000394348

SEQ ID NO: 61433 - protein, 1375 aa, Homo sapiens
  Payload ID: 12270
  Gene Symbol: PNPLA6
  Gene Name: patatin-like phospholipase domain containing 6
  Uniprot ID: Q8IY17
  ENSP ID: ENSP00000407509
MEAPLQTGMMGTSSHGLATNSSGAKVAERDGFQDVLAPGEGSAGRICGAQPVPFVPQVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 61434 - protein, 1300 aa, Homo sapiens
  Payload ID: 12270
  Gene Symbol: PNPLA6
  Gene Name: patatin-like phospholipase domain containing 6
  Uniprot ID: Q8IY17
  ENSP ID: ENSP00000443323
MEAPLQTGMVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 61435 - protein, 155 aa, Homo sapiens
  Payload ID: 12270
  Gene Symbol: PNPLA6
  Gene Name: patatin-like phospholipase domain containing 6
  ENSP ID: ENSP00000469171
  MOD_RES (1)..(1): Any amino acid
XRLNPWADKVKVPDMAEIQSRLAYVSCVRQLEVVKSSSYCEYLRPPIDCFKTMDFGKFDQIYVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 61436 - protein, 117 aa, Homo sapiens
  Payload ID: 12270
  Gene Symbol: PNPLA6
  Gene Name: patatin-like phospholipase domain containing 6
  ENSP ID: ENSP00000469794
MEAPLQTGMVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPP

SEQ ID NO: 61437 - protein, 192 aa, Homo sapiens
  Payload ID: 12270
  Gene Symbol: PNPLA6
  Gene Name: patatin-like phospholipase domain containing 6
  ENSP ID: ENSP00000470060
  MOD_RES (1)..(1): Any amino acid
XYMLKNVRVLGHFEKPLFLELCRHMVFQRLGQGDYVFRPGQPDASIYVVQDGLLELCLPGPDGKECVVKEVVPGDSVNSLLSILDVITHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRE

SEQ ID NO: 61438 - protein, 38 aa, Homo sapiens
  Payload ID: 12270
  Gene Symbol: PNPLA6
  Gene Name: patatin-like phospholipase domain containing 6
  ENSP ID: ENSP00000470461
MEAPLQTGMVLGVMIGAGVAVVVTAVLILLVVRRLRVP

SEQ ID NO: 61439 - protein, 134 aa, Homo sapiens
  Payload ID: 12270
  Gene Symbol: PNPLA6
  Gene Name: patatin-like phospholipase domain containing 6
  ENSP ID: ENSP00000470608
MEAPLQTGMVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHL

SEQ ID NO: 61440 - protein, 267 aa, Homo sapiens
  Payload ID: 12270
  Gene Symbol: PNPLA6
  Gene Name: patatin-like phospholipase domain containing 6
  ENSP ID: ENSP00000472456
  MOD_RES (1)..(1): Any amino acid
XADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGLQGGPRSDFDMAYERGRISVSLQEEASGGSLAAPAR

SEQ ID NO: 61441 - protein, 153 aa, Homo sapiens
  Payload ID: 12270
  Gene Symbol: PNPLA6
  Gene Name: patatin-like phospholipase domain containing 6
  ENSP ID: ENSP00000472572
MEAPLQTGMVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEK

SEQ ID NO: 61442 - protein, 181 aa, Homo sapiens
  Payload ID: 12270
  Gene Symbol: PNPLA6
  Gene Name: patatin-like phospholipase domain containing 6
  ENSP ID: ENSP00000472631
MEAPLQTGMVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPD

SEQ ID NO: 61443 - protein, 1365 aa, Homo sapiens
  Payload ID: 12270
  Gene Symbol: PNPLA6
  Gene Name: patatin-like phospholipase domain containing 6
  Uniprot ID: Q8IY17
  ENSP ID: ENSP00000473211
MGTSSHGLATNSSGAKVAERDGFQDVLAPGEGSAGRICGAQPVPFVPQVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 61444 - protein, 1317 aa, Homo sapiens
  Payload ID: 12271
  Gene Symbol: PNPLA7
  Gene Name: patatin-like phospholipase domain containing 7
  Uniprot ID: Q6ZV29
  ENSP ID: ENSP00000277531
MEEEKDDSPQLTGIAVGALLALALVGVLILFMFRRLRQFRQAQPTPQYRFRKRDKVMFYGRKIMRKVTTLPNTLVENTALPRQRARKRTKVLSLAKRILRFKKEYPALQPKEPPPSLLEADLTEFDVKNSHLPSEVLYMLKNVRVLGHFEKPLFLELCKHIVFVQLQEGEHVFQPREPDPSICVVQDGRLEVCIQDTDGTEVVVKEVLAGDSVHSLLSILDIITGHAAPYKTVSVRAAIPSTILRLPAAAFHGVFEKYPETLVRVVQIIMVRLQRVTFLALHNYLGLTTELFNAESQAIPLVSVASVAAGKAKKQVFYGEEERLKKPPRLQESCDSDHGGGRPAAAGPLLKRSHSVPAPSIRKQILEELEKPGAGDPDPSAPQGGPGSATSDLGMACDRARVFLHSDEHPGSSVASKSRKSVMVAEIPSTVSQHSESHTDETLASRKSDAIFRAAKKDLLTLMKLEDSSLLDGRVALLHVPAGTVVSRQGDQDASILFVVSGLLHVYQRKIGSQEDTCLFLTRPGEMVGQLAVLTGEPLIFTVKANRDCSFLSISKAHFYEIMRKQPTVVLGVAHTVVKRMSSFVRQIDFALDWVEVEAGRAIYRQGDKSDCTYIMLSGRLRSVIRKDDGKKRLAGEYGRGDLVGVVETLTHQARATTVHAVRDSELAKLPAGALTSIKRRYPQVVTRLIHLLGEKILGSLQQGPVTGHQLGLPTEGSKWDLGNPAVNLSTVAVMPVSEEVPLTAFALELEHALSAIGPTLLLTSDNIKRRLGSAALDSVHEYRLSSWLGQQEDTHRIVLYQADGTLTPWTQRCVRQADCILIVGLGDQEPTVGELERMLESTAVRAQKQLILLHREEGPAPARTVEWLNMRSWCSGHLHLCCPRRVFSRRSLPKLVEMYKHVFQRPPDRHSDFSRLARVLTGNAIALVLGGGGARGCAQVGVLKALAECGIPVDMVGGTSIGAFVGALYSEERNYSQMRIRAKQWAEGMTSLMKAALDLTYPITSMFSGAGFNSSIFSVFKDQQIEDLWIPYFAITTDITASAMRVHTDGSLWWYVRASMSLSGYMPPLCDPKDGHLLMDGGYINNLPADVARSMGAKVVIAIDVGSRDETDLTNYGDALSGWWLLWKRWNPLATKVKVLNMAEIQTRLAYVCCVRQLEVVKSSDYCEYLRPPIDSYSTLDFGKFNEICEVGYQHGRTVFDIWGRSGVLEKMLRDQQGPSKKPASAVLTCPNASFTDLAEIVSRIEPAKPAMVDDESDYQTEYEEELLDVPRDAYADFQSTSAQQGSDLEDESSLRHRHPSLAFPKLSEGSSDQDG

SEQ ID NO: 61445 - protein, 1342 aa, Homo sapiens
  Payload ID: 12271
  Gene Symbol: PNPLA7
  Gene Name: patatin-like phospholipase domain containing 7
  Uniprot ID: Q6ZV29
  ENSP ID: ENSP00000384610
MEEEKDDSPQADFCLGTALHSWGLWFTEEGSPSTMLTGIAVGALLALALVGVLILFMFRRLRQFRQAQPTPQYRFRKRDKVMFYGRKIMRKVTTLPNTLVENTALPRQRARKRTKVLSLAKRILRFKKEYPALQPKEPPPSLLEADLTEFDVKNSHLPSEVLYMLKNVRVLGHFEKPLFLELCKHIVFVQLQEGEHVFQPREPDPSICVVQDGRLEVCIQDTDGTEVVVKEVLAGDSVHSLLSILDIITGHAAPYKTVSVRAAIPSTILRLPAAAFHGVFEKYPETLVRVVQIIMVRLQRVTFLALHNYLGLTTELFNAESQAIPLVSVASVAAGKAKKQVFYGEEERLKKPPRLQESCDSDHGGGRPAAAGPLLKRSHSVPAPSIRKQILEELEKPGAGDPDPSAPQGGPGSATSDLGMACDRARVFLHSDEHPGSSVASKSRKSVMVAEIPSTVSQHSESHTDETLASRKSDAIFRAAKKDLLTLMKLEDSSLLDGRVALLHVPAGTVVSRQGDQDASILFVVSGLLHVYQRKIGSQEDTCLFLTRPGEMVGQLAVLTGEPLIFTVKANRDCSFLSISKAHFYEIMRKQPTVVLGVAHTVVKRMSSFVRQIDFALDWVEVEAGRAIYRQGDKSDCTYIMLSGRLRSVIRKDDGKKRLAGEYGRGDLVGVVETLTHQARATTVHAVRDSELAKLPAGALTSIKRRYPQVVTRLIHLLGEKILGSLQQGPVTGHQLGLPTEGSKWDLGNPAVNLSTVAVMPVSEEVPLTAFALELEHALSAIGPTLLLTSDNIKRRLGSAALDSVHEYRLSSWLGQQEDTHRIVLYQADGTLTPWTQRCVRQADCILIVGLGDQEPTVGELERMLESTAVRAQKQLILLHREEGPAPARTVEWLNMRSWCSGHLHLCCPRRVFSRRSLPKLVEMYKHVFQRPPDRHSDFSRLARVLTGNAIALVLGGGGARGCAQVGVLKALAECGIPVDMVGGTSIGAFVGALYSEERNYSQMRIRAKQWAEGMTSLMKAALDLTYPITSMFSGAGFNSSIFSVFKDQQIEDLWIPYFAITTDITASAMRVHTDGSLWWYVRASMSLSGYMPPLCDPKDGHLLMDGGYINNLPADVARSMGAKVVIAIDVGSRDETDLTNYGDALSGWWLLWKRWNPLATKVKVLNMAEIQTRLAYVCCVRQLEVVKSSDYCEYLRPPIDSYSTLDFGKFNEICEVGYQHGRTVFDIWGRSGVLEKMLRDQQGPSKKPASAVLTCPNASFTDLAEIVSRIEPAKPAMVDDESDYQTEYEEELLDVPRDAYADFQSTSAQQGSDLEDESSLRHRHPSLAFPKLSEGSSDQDG

SEQ ID NO: 61446 - protein, 200 aa, Homo sapiens
  Payload ID: 12271
  Gene Symbol: PNPLA7
  Gene Name: patatin-like phospholipase domain containing 7
  ENSP ID: ENSP00000436165
MFRRLRQFRQAQPTPQYRFRKRDKVMFYGRKIMRKVTTLPNTLVENTALPRQRARKRTKVLSLAKRILRFKKEYPALQPKEPPPSLLEADLTEFDVKNSHLPSEVLYMLKNVRVLGHFEKPLFLELCKHIVFVQLQEGEHVFQPREPDPSICVVQDGRLEVCIQDTVPAALMAPQRCRPVAPLPWAGLSLRQAPRSQPQT

SEQ ID NO: 61447 - protein, 782 aa, Homo sapiens
  Payload ID: 12272
  Gene Symbol: PNPLA8
  Gene Name: patatin-like phospholipase domain containing 8
  Uniprot ID: Q9NP80
  ENSP ID: ENSP00000257694
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 61448 - protein, 682 aa, Homo sapiens
  Payload ID: 12272
  Gene Symbol: PNPLA8
  Gene Name: patatin-like phospholipase domain containing 8
  Uniprot ID: Q9NP80
  ENSP ID: ENSP00000387789
MSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 61449 - protein, 55 aa, Homo sapiens
  Payload ID: 12272
  Gene Symbol: PNPLA8
  Gene Name: patatin-like phospholipase domain containing 8
  ENSP ID: ENSP00000391872
MSINLTVDIYIYLLSNARSVCGKQRSKQLYFLFSPKHYWRISHISLQRGFHTNII

SEQ ID NO: 61450 - protein, 720 aa, Homo sapiens
  Payload ID: 12272
  Gene Symbol: PNPLA8
  Gene Name: patatin-like phospholipase domain containing 8
  Uniprot ID: Q9NP80
  ENSP ID: ENSP00000394988
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAADGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 61451 - protein, 639 aa, Homo sapiens
  Payload ID: 12272
  Gene Symbol: PNPLA8
  Gene Name: patatin-like phospholipase domain containing 8
  ENSP ID: ENSP00000402274
MSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIE

SEQ ID NO: 61452 - protein, 192 aa, Homo sapiens
  Payload ID: 12272
  Gene Symbol: PNPLA8
  Gene Name: patatin-like phospholipase domain containing 8
  ENSP ID: ENSP00000406033
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHY

SEQ ID NO: 61453 - protein, 782 aa, Homo sapiens; identical to SEQ ID NO: 61447
  Payload ID: 12272
  Gene Symbol: PNPLA8
  Gene Name: patatin-like phospholipase domain containing 8
  Uniprot ID: Q9NP80
  ENSP ID: ENSP00000406779

SEQ ID NO: 61454 - protein, 782 aa, Homo sapiens; identical to SEQ ID NO: 61447
  Payload ID: 12272
  Gene Symbol: PNPLA8
  Gene Name: patatin-like phospholipase domain containing 8
  Uniprot ID: Q9NP80
  ENSP ID: ENSP00000410804

SEQ ID NO: 61455 - protein, 1447 aa, Homo sapiens
  Payload ID: 12273
  Gene Symbol: PTCH1
  Gene Name: patched 1
  Uniprot ID: Q13635
  ENSP ID: ENSP00000332353
MASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 61456 - protein, 352 aa, Homo sapiens
  Payload ID: 12273
  Gene Symbol: PTCH1
  Gene Name: patched 1
  ENSP ID: ENSP00000364420
KAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISV

SEQ ID NO: 61457 - protein, 1446 aa, Homo sapiens
  Payload ID: 12273
  Gene Symbol: PTCH1
  Gene Name: patched 1
  Uniprot ID: Q13635
  ENSP ID: ENSP00000364423
MELLNRNRLVIVSPRCTPPKASGGPARRGFYTFRSFCKDGGGGEEEEENGGEEKDDRGDKETRSDKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 61458 - protein, 486 aa, Homo sapiens
  Payload ID: 12273
  Gene Symbol: PTCH1
  Gene Name: patched 1
  ENSP ID: ENSP00000364439
GKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQYILMAHRGRLSFNDTLWCGGLKSYMRFPYEE

SEQ ID NO: 61459 - protein, 1381 aa, Homo sapiens
  Payload ID: 12273
  Gene Symbol: PTCH1
  Gene Name: patched 1
  Uniprot ID: Q13635
  ENSP ID: ENSP00000389744
MGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 61460 - protein, 1296 aa, Homo sapiens
  Payload ID: 12273
  Gene Symbol: PTCH1
  Gene Name: patched 1
  Uniprot ID: Q13635
  ENSP ID: ENSP00000396135
MFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 61461 - protein, 1296 aa, Homo sapiens; identical to SEQ ID NO: 61460
  Payload ID: 12273
  Gene Symbol: PTCH1
  Gene Name: patched 1
  Uniprot ID: Q13635
  ENSP ID: ENSP00000399981

SEQ ID NO: 61462 - protein, 1381 aa, Homo sapiens; identical to SEQ ID NO: 61459
  Payload ID: 12273
  Gene Symbol: PTCH1
  Gene Name: patched 1
  Uniprot ID: Q13635
  ENSP ID: ENSP00000410287

SEQ ID NO: 61463 - protein, 1296 aa, Homo sapiens; identical to SEQ ID NO: 61460
  Payload ID: 12273
  Gene Symbol: PTCH1
  Gene Name: patched 1
  Uniprot ID: Q13635
  ENSP ID: ENSP00000414823

SEQ ID NO: 61464 - protein, 174 aa, Homo sapiens
  Payload ID: 12273
  Gene Symbol: PTCH1
  Gene Name: patched 1
  ENSP ID: ENSP00000447008
MFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNG

SEQ ID NO: 61465 - protein, 16 aa, Homo sapiens
  Payload ID: 12273
  Gene Symbol: PTCH1
  Gene Name: patched 1
  ENSP ID: ENSP00000447242
DDRGDKETRSDKLEDE

SEQ ID NO: 61466 - protein, 174 aa, Homo sapiens; identical to SEQ ID NO: 61464
  Payload ID: 12273
  Gene Symbol: PTCH1
  Gene Name: patched 1
  ENSP ID: ENSP00000447797

SEQ ID NO: 61467 - protein, 174 aa, Homo sapiens; identical to SEQ ID NO: 61464
  Payload ID: 12273
  Gene Symbol: PTCH1
  Gene Name: patched 1
  ENSP ID: ENSP00000447878

SEQ ID NO: 61468 - protein, 174 aa, Homo sapiens; identical to SEQ ID NO: 61464
  Payload ID: 12273
  Gene Symbol: PTCH1
  Gene Name: patched 1
  ENSP ID: ENSP00000448843

SEQ ID NO: 61469 - protein, 66 aa, Homo sapiens
  Payload ID: 12273
  Gene Symbol: PTCH1
  Gene Name: patched 1
  ENSP ID: ENSP00000449078
MLNKAEVGHGYMDRPCLNPADPDCPATAPNKNSTKPLDMALVLNGGCHGLSRKYMHWQEELIVGGT

SEQ ID NO: 61470 - protein, 183 aa, Homo sapiens
  Payload ID: 12273
  Gene Symbol: PTCH1
  Gene Name: patched 1
  ENSP ID: ENSP00000449745
MGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLL

SEQ ID NO: 61471 - protein, 79 aa, Homo sapiens
  Payload ID: 12273
  Gene Symbol: PTCH1
  Gene Name: patched 1
  ENSP ID: ENSP00000450047
MFNPQLMIQTPKEEGANVLTTEALLQHLDSALQASRVHVYMYNSEKFLSLLFILLGSGNWNICVTNQESLSQKQVTWIR

SEQ ID NO: 61472 - protein, 92 aa, Homo sapiens
  Payload ID: 12273
  Gene Symbol: PTCH1
  Gene Name: patched 1
  ENSP ID: ENSP00000450131
MFNPQLMIQTPKEEGANVLTTEALLQHLDSALQASRVHVYMYNRQWKLEHLCYKSGELITETGYMDQIIEYLYPCLIITPLDCFWEGAKLQS

SEQ ID NO: 61473 - protein, 1203 aa, Homo sapiens
  Payload ID: 12274
  Gene Symbol: PTCH2
  Gene Name: patched 2
  Uniprot ID: Q9Y6C5
  ENSP ID: ENSP00000361266
MTRSPPLRELPPSYTPPARTAAPQILAGSLKAPLWLRAYFQGLLFSLGCGIQRHCGKVLFLGLLAFGALALGLRMAIIETNLEQLWVEVGSRVSQELHYTKEKLGEEAAYTSQMLIQTARQEGENILTPEALGLHLQAALTASKVQVSLYGKSWDLNKICYKSGVPLIENGMIERMIEKLFPCVILTPLDCFWEGAKLQGGSAYLPGRPDIQWTNLDPEQLLEELGPFASLEGFRELLDKAQVGQAYVGRPCLHPDDLHCPPSAPNHHSRQAPNVAHELSGGCHGFSHKFMHWQEELLLGGMARDPQGELLRAEALQSTFLLMSPRQLYEHFRGDYQTHDIGWSEEQASTVLQAWQRRFVQLAQEALPENASQQIHAFSSTTLDDILHAFSEVSAARVVGGYLLMLAYACVTMLRWDCAQSQGSVGLAGVLLVALAVASGLGLCALLGITFNAATTQVLPFLALGIGVDDVFLLAHAFTEALPGTPLQERMGECLQRTGTSVVLTSINNMAAFLMAALVPIPALRAFSLQAAIVVGCTFVAVMLVFPAILSLDLRRRHCQRLDVLCCFSSPCSAQVIQILPQELGDGTVPVGIAHLTATVQAFTHCEASSQHVVTILPPQAHLVPPPSDPLGSELFSPGGSTRDLLGQEEETRQKAACKSLPCARWNLAHFARYQFAPLLLQSHAKAIVLVLFGALLGLSLYGATLVQDGLALTDVVPRGTKEHAFLSAQLRYFSLYEVALVTQGGFDYAHSQRALFDLHQRFSSLKAVLPPPATQAPRTWLHYYRNWLQGIQAAFDQDWASGRITRHSYRNGSEDGALAYKLLIQTGDAQEPLDFSQLTTRKLVDREGLIPPELFYMGLTVWVSSDPLGLAASQANFYPPPPEWLHDKYDTTGENLRIPPAQPLEFAQFPFLLRGLQKTADFVEAIEGARAACAEAGQAGVHAYPSGSPFLFWEQYLGLRRCFLLAVCILLVCTFLVCALLLLNPWTAGLIVLVLAMMTVELFGIMGFLGIKLSAIPVVILVASVGIGVEFTVHVALGFLTTQGSRNLRAAHALEHTFAPVTDGAISTLLGLLMLAGSHFDFIVRYFFAALTVLTLLGLLHGLVLLPVLLSILGPPPEVIQMYKESPEILSPPAPQGGGLRWGASSSLPQSFARVTTSMTVAIHPPPLPGAYIHPAPDEPPWSPAATSSGNLSSRGPGPATG

SEQ ID NO: 61474 - protein, 1146 aa, Homo sapiens
  Payload ID: 12274
  Gene Symbol: PTCH2
  Gene Name: patched 2
  Uniprot ID: Q9Y6C5
  ENSP ID: ENSP00000389703
MTRSPPLRELPPSYTPPARTAAPQILAGSLKAPLWLRAYFQGLLFSLGCGIQRHCGKVLFLGLLAFGALALGLRMAIIETNLEQLWVEVGSRVSQELHYTKEKLGEEAAYTSQMLIQTARQEGENILTPEALGLHLQAALTASKVQVSLYGKSWDLNKICYKSGVPLIENGMIERMIEKLFPCVILTPLDCFWEGAKLQGGSAYLPGRPDIQWTNLDPEQLLEELGPFASLEGFRELLDKAQVGQAYVGRPCLHPDDLHCPPSAPNHHSRQAPNVAHELSGGCHGFSHKFMHWQEELLLGGMARDPQGELLRAEALQSTFLLMSPRQLYEHFRGDYQTHDIGWSEEQASTVLQAWQRRFVQLAQEALPENASQQIHAFSSTTLDDILHAFSEVSAARVVGGYLLMLAYACVTMLRWDCAQSQGSVGLAGVLLVALAVASGLGLCALLGITFNAATTQVLPFLALGIGVDDVFLLAHAFTEALPGTPLQERMGECLQRTGTSVVLTSINNMAAFLMAALVPIPALRAFSLQAAIVVGCTFVAVMLVFPAILSLDLRRRHCQRLDVLCCFSSPCSAQVIQILPQELGDGTVPVGIAHLTATVQAFTHCEASSQHVVTILPPQAHLVPPPSDPLGSELFSPGGSTRDLLGQEEETRQKAACKSLPCARWNLAHFARYQFAPLLLQSHAKAIVLVLFGALLGLSLYGATLVQDGLALTDVVPRGTKEHAFLSAQLRYFSLYEVALVTQGGFDYAHSQRALFDLHQRFSSLKAVLPPPATQAPRTWLHYYRNWLQGIQAAFDQDWASGRITRHSYRNGSEDGALAYKLLIQTGDAQEPLDFSQLTTRKLVDREGLIPPELFYMGLTVWVSSDPLGLAASQANFYPPPPEWLHDKYDTTGENLRIPPAQPLEFAQFPFLLRGLQKTADFVEAIEGARAACAEAGQAGVHAYPSGSPFLFWEQYLGLRRCFLLAVCILLVCTFLVCALLLLNPWTAGLIVLVLAMMTVELFGIMGFLGIKLSAIPVVILVASVGIGVEFTVHVALGFLTTQGSRNLRAAHALEHTFAPVTDGAISTLLGLLMLAGSHFDFIVRYFFAALTVLTLLGLLHGLVLLPVLLSILGPPPEVIQMYKESPEILSPPAPQGGGLRPEEI

SEQ ID NO: 61475 - protein, 88 aa, Homo sapiens
  Payload ID: 12274
  Gene Symbol: PTCH2
  Gene Name: patched 2
  ENSP ID: ENSP00000413169
  MOD_RES (1)..(1): Any amino acid
XFDFIVRYFFAALTVLTLLGLLHGLVLLPVLLSILGPPPEVIQMYKESPEILSPPAPQGGGLRVGSLQVNISYWKELLWCQDLRPEEI

SEQ ID NO: 61476 - protein, 888 aa, Homo sapiens
  Payload ID: 12275
  Gene Symbol: PTCHD1
  Gene Name: patched domain containing 1
  Uniprot ID: Q96NR3
  ENSP ID: ENSP00000368666
MLRQVLHRGLRTCFSRLGHFIASHPVFFASAPVLISILLGASFSRYQVEESVEHLLAPQHSLAKIERNLVNSLFPVNRSKHRLYSDLQTPGRYGRVIVTSFQKANMLDQHHTDLILKLHAAVTKIQVPRPGFNYTFAHICILNNDKTCIVDDIVHVLEELKNARATNRTNFAITYPITHLKDGRAVYNGHQLGGVTVHSKDRVKSAEAIQLTYYLQSINSLNDMVAERWESSFCDTVRLFQKSNSKVKMYPYTSSSLREDFQKTSRVSERYLVTSLILVVTMAILCCSMQDCVRSKPWLGLLGLVTISLATLTAAGIINLTGGKYNSTFLGVPFVMLGHGLYGTFEMLSSWRKTREDQHVKERTAAVYADSMLSFSLTTAMYLVTFGIGASPFTNIEAARIFCCNSCIAIFFNYLYVLSFYGSSLVFTGYIENNYQHSIFCRKVPKPEALQEKPAWYRFLLTARFSEDTAEGEEANTYESHLLVCFLKRYYCDWITNTYVKPFVVLFYLIYISFALMGYLQVSEGSDLSNIVATATQTIEYTTAQQKYFSNYSPVIGFYIYESIEYWNTSVQEDVLEYTKGFVRISWFESYLNYLRKLNVSTGLPKKNFTDMLRNSFLKAPQFSHFQEDIIFSKKYNDEVDVVASRMFLVAKTMETNREELYDLLETLRRLSVTSKVKFIVFNPSFVYMDRYASSLGAPLHNSCISALFLLFFSAFLVADSLINVWITLTVVSVEFGVIGFMTLWKVELDCISVLCLIYGINYTIDNCAPMLSTFVLGKDFTRTKWVKNALEVHGVAILQSYLCYIVGLIPLAAVPSNLTCTLFRCLFLIAFVTFFHCFAILPVILTFLPPSKKKRKEKKNPENREEIECVEMVDIDSTRVVDQITTV

SEQ ID NO: 61477 - protein, 103 aa, Homo sapiens
  Payload ID: 12275
  Gene Symbol: PTCHD1
  Gene Name: patched domain containing 1
  ENSP ID: ENSP00000406663
  MOD_RES (1)..(1): Any amino acid
XERNLVNSLFPVNRSKHRLYSDLQTPGRYGRVIVTSFQKANMLDQHHTDLILKVMDYMGLLKCYPPGGKLEKTNMLKRELQQSMQTPCSPFLSPLPCTWSPLA

SEQ ID NO: 61478 - protein, 256 aa, Homo sapiens
  Payload ID: 12275
  Gene Symbol: PTCHD1
  Gene Name: patched domain containing 1
  Uniprot ID: Q96NR3
  ENSP ID: ENSP00000478663
MLDQHHTDLILKLHAAVTKIQVPRPGFNYTFAHICILNNDKTCIVDDIVHVLEELKNARATNRTNFAITYPITHLKDGRAVYNGHQLGGVTVHSKDRVKSAEAIQLTYYLQSINSLNDMVAERWESSFCDTVRLFQKSNSKVKMYPYTSSSLREDFQKTSRVSERYLVTSLILVVTMAILCCSMQDCVRSKPWLGLLGLVTISLATLTAAGIINLTGGKYNSTFLGVPFVMLGNYYSSFFCFRLLVVLTRFLKGQE

SEQ ID NO: 61479 - protein, 1392 aa, Homo sapiens
  Payload ID: 12276
  Gene Symbol: PTCHD2
  Gene Name: patched domain containing 2
  Uniprot ID: Q9P2K9
  ENSP ID: ENSP00000294484
MDTEDDPLLQDVWLEEEQEEEEATGETFLGAQKPGPQPGAGGQCCWRHWPLASRPPASGFWSTLGWAFTNPCCAGLVLFLGCSIPMALSAFMFLYYPPLDIDISYNAFEIRNHEASQRFDALTLALKSQFGSWGRNRRDLADFTSETLQRLISEQLQQLHLGNRSRQASRAPRVIPAASLGGPGPYRDTSAAQKPTANRSGRLRRETPPLEDLAANQSEDPRNQRLSKNGRYQPSIPPHAAVAANQSRARRGASRWDYSRAYVSANTQTHAHWRIELIFLARGDAERNIFTSERLVTIHEIERKIMDHPGFREFCWKPHEVLKDLPLGSYSYCSPPSSLMTYFFPTERGGKIYYDGMGQDLADIRGSLELAMTHPEFYWYVDEGLSADNLKSSLLRSEILFGAPLPNYYSVDDRWEEQRAKFQSFVVTYVAMLAKQSTSKVQVLYGGTDLFDYEVRRTFNNDMLLAFISSSCIAALVYILTSCSVFLSFFGIASIGLSCLVALFLYHVVFGIQYLGILNGVAAFVIVGIGVDDVFVFINTYRQATHLEDPQLRMIHTVQTAGKATFFTSLTTAAAYAANVFSQIPAVHDFGLFMSLIVSCCWLAVLVTMPAALGLWSLYLAPLESSCQTSCHQNCSRKTSLHFPGDVFAAPEQVGGSPAQGPIPYLDDDIPLLEVEEEPVSLELGDVSLVSVSPEGLQPASNTGSRGHLIVQLQELLHHWVLWSAVKSRWVIVGLFVSILILSLVFASRLRPASRAPLLFRPDTNIQVLLDLKYNLSAEGISCITCSGLFQEKPHSLQNNIRTSLEKKRRGSGVPWASRPEATLQDFPGTVYISKVKSQGHPAVYRLSLNASLPAPWQAVSPGDGEVPSFQVYRAPFGNFTKKLTACMSTVGLLQAASPSRKWMLTTLACDAKRGWKFDFSFYVATKEQQHTRKLYFAQSHKPPFHGRVCMAPPGCLLSSSPDGPTKGFFFVPSEKVPKARLSATFGFNPCVNTGCGKPAVRPLVDTGAMVFVVFGIIGVNRTRQVDNHVIGDPGSVVYDSSFDLFKEIGHLCHLCKAIAANSELVKPGGAQCLPSGYSISSFLQMLHPECKELPEPNLLPGQLSHGAVGVREGRVQWISMAFESTTYKGKSSFQTYSDYLRWESFLQQQLQALPEGSVLRRGFQTCEHWKQIFMEIVGVQSALCGLVLSLLICVAAVAVFTTHILLLLPVLLSILGIVCLVVTIMYWSGWEMGAVEAISLSILVGSSVDYCVHLVEGYLLAGENLPPHQAEDARTQRQWRTLEAVRHVGVAIVSSALTTVIATVPLFFCIIAPFAKFGKIVALNTGVSILYTLTVSTALLGIMAPSSFTRTRTSFLKALGAVLLAGALGLGACLVLLQSGYKIPLPAGASL

SEQ ID NO: 61480 - protein, 268 aa, Homo sapiens
  Payload ID: 12276
  Gene Symbol: PTCHD2
  Gene Name: patched domain containing 2
  ENSP ID: ENSP00000303400
MSRYLKNLLEQDHVQGQILLPDLLGLPALGELPPAAAAGLARGLSPAPGLPDLRALEADIHGNRRGAERPVRPGAIPAHLRGRGGRVHHPHPAPAARAPQHLGHRVPGGDHHVLERLGDGGCGSHLPVHPRWLLRGLLRPPGRGLPAGWREPAPPPGRGRPNAAPVAYAGGRAARGRGHRLQCPHHGHRHSAPLLLHHRPICQVRQDCGTQHGRVHPLHADRQHRPAGHHGAQLFHSDPDFLPQGPGCRAAGRGPGAGCLPRAPAERL

SEQ ID NO: 61481 - protein, 767 aa, Homo sapiens
  Payload ID: 12277
  Gene Symbol: PTCHD3
  Gene Name: patched domain containing 3
  Uniprot ID: Q3KNS1
  ENSP ID: ENSP00000417658
MPWVEPKPRPGPEQKPKLTKPDSATGPQWYQESQESESEGKQPPPGPLAPPKSPEPSGPLASEQDAPLPEGDDAPPRPSMLDDAPRLPLELDDAPLPEEETPEPTAICRHRHRCHTDCLEGLLSRTFQWLGWQVGAHPWIFLLAPLMLTAALGTGFLYLPKDEEEDLEEHYTPVGSPAKAERRFVQGHFTTNDSYRFSASRRSTEANFVSLLVVSYSDSLLDPATFAEVSKLDGAVQDLRVAREKGSQIQYQQVCARYRALCVPPNPILYAWQVNKTLNLSSISFPAYNHGRHPLYLTGFFGGYILGGSLGMGQLLLRAKAMRLLYYLKTEDPEYDVQSKQWLTHLLDQFTNIKNILALKKIEVVHFTSLSRQLEFEATSVTVIPVFHLAYILIILFAVTSCFRFDCIRNKMCVAAFGVISAFLAVVSGFGLLLHIGVPFVIIVANSPFLILGVGVDDMFIMISAWHKTNLADDIRERMSNVYSKAAVSITITTITNILALYTGIMSSFRSVQCFCIYTGMTLLFCYFYNITCFGAFMALDGKREVVCLCWLKKADPKWPSFKKFCCFPFGSVPDEHGTDIHPISLFFRDYFGPFLTRSESKYFVVFIYVLYIISSIYGCFHVQEGLDLRNLASDDSYITPYFNVEENYFSDYGPRVMVIVTKKVDYWDKDVRQKLENCTKIFEKNVYVDKNLTEFWLDAYVQYLKGNSQDPNEKNTFMNNIPDFLSNFPNFQHDINISSSNEIISSRGFIQTTDVSSSAKKKILLF

SEQ ID NO: 61482 - protein, 533 aa, Homo sapiens
  Payload ID: 12277
  Gene Symbol: PTCHD3
  Gene Name: patched domain containing 3
  ENSP ID: ENSP00000478346
MPWVEPKPRPGPEQKPKLTKPDSATGPQWYQESQESESEGKQPPPGPLAPPKSPEPSGPLASEQDAPLPEGDDAPPRPSMLDDAPRLPLELDDAPLPEEETPEPTAICRHRHRCHTDCLEGLLSRTFQWLGWQVGAHPWIFLLAPLMLTAALGTGFLYLPKDEEEDLEEHYTPVGSPAKAERRFVQGHFTTNDSYRFSASRRSTEANFVSLLVVSYSDSLLDPATFAEVSKLDGAVQDLRVAREKGSQIQYQQVCARYRALCVPPNPILYAWQVNKTLNLSSISFPAYNHGRHPLYLTGFFGGYILGGSLGMGQLLLRAKAMRLLYYLKTEDPEYDVQSKQWLTHLLDQFTNIKNILALKKIEVVHFTSLSRQLEFEATSVTVIPVFHLAYILIILFAVTSCFRFDCIRNKMCVAAFGVISAFLAVVSGFGLLLHIGVPFVIIVANSPFLILGVGVDDMFIMISAWHKTNLADDIRERMSNVYSKAAVSITITTITNILALYTGIMSSFRASFRQQMFLPQPKRKYCYSNYDA

SEQ ID NO: 61483 - protein, 533 aa, Homo sapiens; identical to SEQ ID NO: 61482
  Payload ID: 12277
  Gene Symbol: PTCHD3
  Gene Name: patched domain containing 3
  ENSP ID: ENSP00000479436

SEQ ID NO: 61484 - protein, 767 aa, Homo sapiens; identical to SEQ ID NO: 61481
  Payload ID: 12277
  Gene Symbol: PTCHD3
  Gene Name: patched domain containing 3
  Uniprot ID: Q3KNS1
  ENSP ID: ENSP00000484143

SEQ ID NO: 61485 - protein, 846 aa, Homo sapiens
  Payload ID: 12278
  Gene Symbol: PTCHD4
  Gene Name: patched domain containing 4
  Uniprot ID: Q6ZW05
  ENSP ID: ENSP00000341914
MCFLRRPGAPASWIWWRMLRQVLRRGLQSFCHRLGLCVSRHPVFFLTVPAVLTITFGLSALNRFQPEGDLERLVAPSHSLAKIERSLASSLFPLDQSKSQLYSDLHTPGRYGRVILLSPTGDNILLQAEGILQTHRAVLEMKDGRNSFIGHQLGGVVEVPNSKDQRVKSARAIQITYYLQTYGSATQDLIGEKWENEFCKLIRKLQEEHQELQLYSLASFSLWRDFHKTSILARSKVLVSLVLILTTATLSSSMKDCLRSKPFLGLLGVLTVCISIITAAGIFFITDGKYNSTLLGIPFFAMGHGTKGVFELLSGWRRTKENLPFKDRIADAYSDVMVTYTMTSSLYFITFGMGASPFTNIEAVKVFCQNMCVSILLNYFYIFSFFGSCLVFAGQLEQNRYHSIFCCKIPSAEYLDRKPVWFQTVMSDGHQQTSHHETNPYQHHFIQHFLREHYNEWITNIYVKPFVVILYLIYASFSFMGCLQISDGANIINLLASDSPSVSYAMVQQKYFSNYSPVIGFYVYEPLEYWNSSVQDDLRRLCSGFTAVSWVEQYYQFLKVSNVSANNKSDFISVLQSSFLKKPEFQHFRNDIIFSKAGDESNIIASRLYLVARTSRDKQKEITEVLEKLRPLSLSKSIRFIVFNPSFVFMDHYSLSVTVPVLIAGFGVLLVLILTFFLVIHPLGNFWLILSVTSIELGVLGLMTLWNVDMDCISILCLIYTLNFAIDHCAPLLFTFVLATEHTRTQCIKSSLQDHGTAILQNVTSFLIGLVPLLFVPSNLTFTLFKCLLLTGGCTLLHCFVILPVFLTFFPPSKKHHKKKKRAKRKEREEIECIEIQENPDHVTTV

SEQ ID NO: 61486 - protein, 311 aa, Homo sapiens
  Payload ID: 12278
  Gene Symbol: PTCHD4
  Gene Name: patched domain containing 4
  ENSP ID: ENSP00000381722
  MOD_RES (1)..(1): Any amino acid
XCFLRRPGAPASWIWWRMLRQVLRRGLQSFCHRLGLCVSRHPVFFLTVPAVLTITFGLSALNRFQPEGDLERLVAPSHSLAKIERSLASSLFPLDQSKSQLYSDLHTPGRYGRVILLSPTGDNILLQAEGILQTHRAVLEMKDGRNSFIGHQLGGVVEVPNSKDQRVKSARAIQITYYLQTYGSATQDLIGEKWENEFCKLIRKLQEEHQELQLYSLASFSLWRDFHKTSILARSKVLVSLVLILTTATLSSSMKDCLRSKPFLGLLGVLTVCISIITAAGIFFITDGKYNSTLLGIPFFAMGISTEFTSS

SEQ ID NO: 61487 - protein, 325 aa, Homo sapiens
  Payload ID: 12279
  Gene Symbol: PEG10
  Gene Name: paternally expressed 10
  Uniprot ID: Q86TG7
  ENSP ID: ENSP00000417587
MTERRRDELSEEINNLREKVMKQSEENNNLQSQVQKLTEENTTLREQVEPTPEDEDDDIELRGAAAAAAPPPPIEEECPEDLPEKFDGNPDMLAPFMAQCQIFMEKSTRDFSVDRVRVCFVTSMMTGRAARWASAKLERSHYLMHNYPAFMMEMKHVFEDPQRREVAKRKIRRLRQGMGSVIDYSNAFQMIAQDLDWNEPALIDQYHEGLSDHIQEELSHLEVAKSLSALIGQCIHIERRLARAAAARKPRSPPRALVLPHIASHHQVDPTEPVGGARMRLTQEEKERRRKLNLCLYCGTGGHYADNCPAKASKSSPAGNSPAPL

SEQ ID NO: 61488 - protein, 401 aa, Homo sapiens
  Payload ID: 12279
  Gene Symbol: PEG10
  Gene Name: paternally expressed 10
  ENSP ID: ENSP00000418944
MRNKRVLKTKKRRSGRGGQDPGLHPHRSEATAGRSPPTPTVTLGPDCPPPPPPPPPNNNNNNNSKHTGHKSACVPNMTERRRDELSEEINNLREKVMKQSEENNNLQSQVQKLTEENTTLREQVEPTPEDEDDDIELRGAAAAAAPPPPIEEECPEDLPEKFDGNPDMLAPFMAQCQIFMEKSTRDFSVDRVRVCFVTSMMTGRAARWASAKLERSHYLMHNYPAFMMEMKHVFEDPQRREVAKRKIRRLRQGMGSVIDYSNAFQMIAQDLDWNEPALIDQYHEGLSDHIQEELSHLEVAKSLSALIGQCIHIERRLARAAAARKPRSPPRALVLPHIASHHQVDPTEPVGGARMRLTQEEKERRRKLNLCLYCGTGGHYADNCPAKASKSSPAGNSPAPL

SEQ ID NO: 61489 - protein, 741 aa, Homo sapiens
  Payload ID: 12279
  Gene Symbol: PEG10
  Gene Name: paternally expressed 10
  ENSP ID: ENSP00000478744
LGPDCPPPPPPPPPNNNNNNNSKHTGHKSACVPNMTERRRDELSEEINNLREKVMKQSEENNNLQSQVQKLTEENTTLREQVEPTPEDEDDDIELRGAAAAAAPPPPIEEECPEDLPEKFDGNPDMLAPFMAQCQIFMEKSTRDFSVDRVRVCFVTSMMTGRAARWASAKLERSHYLMHNYPAFMMEMKHVFEDPQRREVAKRKIRRLRQGMGSVIDYSNAFQMIAQDLDWNEPALIDQYHEGLSDHIQEELSHLEVAKSLSALIGQCIHIERRLARAAAARKPRSPPRALVLPHIASHHQVDPTEPVGGARMRLTQEEKERRRKLNLCLYCGTGGHYADNCPAKASKSSPGKLPGPAVEGPSATGPEIIRSPQDDASSPHLQVMLQIHLPGRHTLFVRAMIDSGASGNFIDHEYVAQNGIPLRIKDWPILVEAIDGRPIASGPVVHETHDLIVDLGDHREVLSFDVTQSPFFPVVLGVRWLSTHDPNITWSTRSIVFDSEYCRYHCRMYSPIPPSLPPPAPQPPLYYPVDGYRVYQPVRYYYVQNVYTPVDEHVYPDHRLVDPHIEMIPGAHSIPSGHVYSLSEPEMAALRDFVARNVKDGLITPTIAPNGAQVLQVKRGWKLQVSYDCRAPNNFTIQNQYPRLSIPNLEDQAHLATYTEFVPQIPGYQTYPTYAAYPTYPVGFAWYPVGRDGQGRSLYVPVMITWNPHWYRQPPVPQYPPPQPPPPPPPPPPPPSYSTL

SEQ ID NO: 61490 - protein, 783 aa, Homo sapiens
  Payload ID: 12279
  Gene Symbol: PEG10
  Gene Name: paternally expressed 10
  ENSP ID: ENSP00000480676
MRNKRVLKTKKRRSGRGGQDPGLHPHRSEATAGRSPPTPTVTLGPDCPPPPPPPPPNNNNNNNSKHTGHKSACVPNMTERRRDELSEEINNLREKVMKQSEENNNLQSQVQKLTEENTTLREQVEPTPEDEDDDIELRGAAAAAAPPPPIEEECPEDLPEKFDGNPDMLAPFMAQCQIFMEKSTRDFSVDRVRVCFVTSMMTGRAARWASAKLERSHYLMHNYPAFMMEMKHVFEDPQRREVAKRKIRRLRQGMGSVIDYSNAFQMIAQDLDWNEPALIDQYHEGLSDHIQEELSHLEVAKSLSALIGQCIHIERRLARAAAARKPRSPPRALVLPHIASHHQVDPTEPVGGARMRLTQEEKERRRKLNLCLYCGTGGHYADNCPAKASKSSPGKLPGPAVEGPSATGPEIIRSPQDDASSPHLQVMLQIHLPGRHTLFVRAMIDSGASGNFIDHEYVAQNGIPLRIKDWPILVEAIDGRPIASGPVVHETHDLIVDLGDHREVLSFDVTQSPFFPVVLGVRWLSTHDPNITWSTRSIVFDSEYCRYHCRMYSPIPPSLPPPAPQPPLYYPVDGYRVYQPVRYYYVQNVYTPVDEHVYPDHRLVDPHIEMIPGAHSIPSGHVYSLSEPEMAALRDFVARNVKDGLITPTIAPNGAQVLQVKRGWKLQVSYDCRAPNNFTIQNQYPRLSIPNLEDQAHLATYTEFVPQIPGYQTYPTYAAYPTYPVGFAWYPVGRDGQGRSLYVPVMITWNPHWYRQPPVPQYPPPQPPPPPPPPPPPPSYSTL

SEQ ID NO: 61491 - protein, 707 aa, Homo sapiens
  Payload ID: 12279
  Gene Symbol: PEG10
  Gene Name: paternally expressed 10
  ENSP ID: ENSP00000481101
MTERRRDELSEEINNLREKVMKQSEENNNLQSQVQKLTEENTTLREQVEPTPEDEDDDIELRGAAAAAAPPPPIEEECPEDLPEKFDGNPDMLAPFMAQCQIFMEKSTRDFSVDRVRVCFVTSMMTGRAARWASAKLERSHYLMHNYPAFMMEMKHVFEDPQRREVAKRKIRRLRQGMGSVIDYSNAFQMIAQDLDWNEPALIDQYHEGLSDHIQEELSHLEVAKSLSALIGQCIHIERRLARAAAARKPRSPPRALVLPHIASHHQVDPTEPVGGARMRLTQEEKERRRKLNLCLYCGTGGHYADNCPAKASKSSPGKLPGPAVEGPSATGPEIIRSPQDDASSPHLQVMLQIHLPGRHTLFVRAMIDSGASGNFIDHEYVAQNGIPLRIKDWPILVEAIDGRPIASGPVVHETHDLIVDLGDHREVLSFDVTQSPFFPVVLGVRWLSTHDPNITWSTRSIVFDSEYCRYHCRMYSPIPPSLPPPAPQPPLYYPVDGYRVYQPVRYYYVQNVYTPVDEHVYPDHRLVDPHIEMIPGAHSIPSGHVYSLSEPEMAALRDFVARNVKDGLITPTIAPNGAQVLQVKRGWKLQVSYDCRAPNNFTIQNQYPRLSIPNLEDQAHLATYTEFVPQIPGYQTYPTYAAYPTYPVGFAWYPVGRDGQGRSLYVPVMITWNPHWYRQPPVPQYPPPQPPPPPPPPPPPPSYSTL

SEQ ID NO: 61492 - protein, 31 aa, Homo sapiens
  Payload ID: 12279
  Gene Symbol: PEG10
  Gene Name: paternally expressed 10
  ENSP ID: ENSP00000482046
MTERRRDELSEEINNLREKVMKQSEENNNLQ

SEQ ID NO: 61493 - protein, 359 aa, Homo sapiens
  Payload ID: 12279
  Gene Symbol: PEG10
  Gene Name: paternally expressed 10
  ENSP ID: ENSP00000482653
LGPDCPPPPPPPPPNNNNNNNSKHTGHKSACVPNMTERRRDELSEEINNLREKVMKQSEENNNLQSQVQKLTEENTTLREQVEPTPEDEDDDIELRGAAAAAAPPPPIEEECPEDLPEKFDGNPDMLAPFMAQCQIFMEKSTRDFSVDRVRVCFVTSMMTGRAARWASAKLERSHYLMHNYPAFMMEMKHVFEDPQRREVAKRKIRRLRQGMGSVIDYSNAFQMIAQDLDWNEPALIDQYHEGLSDHIQEELSHLEVAKSLSALIGQCIHIERRLARAAAARKPRSPPRALVLPHIASHHQVDPTEPVGGARMRLTQEEKERRRKLNLCLYCGTGGHYADNCPAKASKSSPAGNSPAPL

SEQ ID NO: 61494 - protein, 1588 aa, Homo sapiens
  Payload ID: 12280
  Gene Symbol: PEG3
  Gene Name: paternally expressed 3
  Uniprot ID: Q9GZU2
  ENSP ID: ENSP00000326581
MLPPKHLSATKPKKSWAPNLYELDSDLTKEPDVIIGEGPTDSEFFHQRFRNLIYVEFVGPRKTLIKLRNLCLDWLQPETRTKEEIIELLVLEQYLTIIPEKLKPWVRAKKPENCEKLVTLLENYKEMYQPEDDNNSDVTSDDDMTRNRRESSPPHSVHSFSDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 61495 - protein, 36 aa, Homo sapiens
  Payload ID: 12280
  Gene Symbol: PEG3
  Gene Name: paternally expressed 3
  ENSP ID: ENSP00000469144
MLPPKHLSATKPKKSWAPNLYELDSDLTKEPDVIIG

SEQ ID NO: 61496 - protein, 1588 aa, Homo sapiens; identical to SEQ ID NO: 61494
  Payload ID: 12280
  Gene Symbol: PEG3
  Gene Name: paternally expressed 3
  Uniprot ID: Q9GZU2
  ENSP ID: ENSP00000469486

SEQ ID NO: 61497 - protein, 395 aa, Homo sapiens
  Payload ID: 12280
  Gene Symbol: PEG3
  Gene Name: paternally expressed 3
  ENSP ID: ENSP00000470467
MYQPEDDNNSDVTSDDDMTRNRRESSPPHSVHSFSGDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTF

SEQ ID NO: 61498 - protein, 1588 aa, Homo sapiens; identical to SEQ ID NO: 61494
  Payload ID: 12280
  Gene Symbol: PEG3
  Gene Name: paternally expressed 3
  Uniprot ID: Q9GZU2
  ENSP ID: ENSP00000472395

SEQ ID NO: 61499 - protein, 1462 aa, Homo sapiens
  Payload ID: 12280
  Gene Symbol: PEG3
  Gene Name: paternally expressed 3
  Uniprot ID: Q9GZU2
  ENSP ID: ENSP00000472402
MYQPEDDNNSDVTSDDDMTRNRRESSPPHSVHSFSDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 61500 - protein, 1464 aa, Homo sapiens
  Payload ID: 12280
  Gene Symbol: PEG3
  Gene Name: paternally expressed 3
  Uniprot ID: Q9GZU2
  ENSP ID: ENSP00000473190
MYQPEDDNNSDVTSDDDMTRNRRESSPPHSVHSFSGDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 61501 - protein, 1069 aa, Homo sapiens
  Payload ID: 12281
  Gene Symbol: PAXIP1
  Gene Name: PAX interacting (with transcription-activation domain) protein 1
  Uniprot ID: Q6ZW49
  ENSP ID: ENSP00000380376
MSDQAPKVPEEMFREVKYYAVGDIDPQVIQLLKAGKAKEVSYNALASHIISEDGDNPEVGEAREVFDLPVVKPSWVILSVQCGTLLPVNGFSPESCQIFFGITACLSQVSSEDRSALWALVTFYGGDCQLTLNKKCTHLIVPEPKGEKYECALKRASIKIVTPDWVLDCVSEKTKKDEAFYHPRLIIYEEEEEEEEEEEEVENEEQDSQNEGSTDEKSSPASSQEGSPSGDQQFSPKSNTEKSKGELMFDDSSDSSPEKQERNLNWTPAEVPQLAAAKRRLPQGKEPGLINLCANVPPVPGNILPPEVRGNLMAAGQNLQSSERSEMIATWSPAVRTLRNITNNADIQQMNRPSNVAHILQTLSAPTKNLEQQVNHSQQGHTNANAVLFSQVKVTPETHMLQQQQQAQQQQQQHPVLHLQPQQIMQLQQQQQQQISQQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKEWRIPCVNAQWLGDILLGNFEALRQIQYSRYTAFSLQDPFAPTQHLVLNLLDAWRVPLKVSAELLMSIRLPPKLKQNEVANVQPSSKRARIEDVPPPTKKLTPELTPFVLFTGFEPVQVQQYIKKLYILGGEVAESAQKCTHLIASKVTRTVKFLTAISVVKHIVTPEWLEECFRCQKFIDEQNYILRDAEAEVLFSFSLEESLKRAHVSPLFKAKYFYITPGICPSLSTMKAIVECAGGKVLSKQPSFRKLMEHKQNSSLSEIILISCENDLHLCREYFARGIDVHNAEFVLTGVLTQTLDYESYKFN

SEQ ID NO: 61502 - protein, 1069 aa, Homo sapiens; identical to SEQ ID NO: 61501
  Payload ID: 12281
  Gene Symbol: PAXIP1
  Gene Name: PAX interacting (with transcription-activation domain) protein 1
  Uniprot ID: Q6ZW49
  ENSP ID: ENSP00000384048

SEQ ID NO: 61503 - protein, 173 aa, Homo sapiens
  Payload ID: 12281
  Gene Symbol: PAXIP1
  Gene Name: PAX interacting (with transcription-activation domain) protein 1
  ENSP ID: ENSP00000389849
KVPEEMFREVKYYAVGDIDPQVIQLLKAGKAKEVSYNALASHIISEDGDNPEVGEAREVFDLPVVKVSSEDRSALWALVTFYGGDCQLTLNKKCTHLIVPEPKGEKYECALKRASIKIVTPDWVLDCVSEKTKKDEAFYHPRLIIYEEEEEEEEEEEEVENEEQDSQNEGSTD

SEQ ID NO: 61504 - protein, 147 aa, Homo sapiens
  Payload ID: 12281
  Gene Symbol: PAXIP1
  Gene Name: PAX interacting (with transcription-activation domain) protein 1
  ENSP ID: ENSP00000392011
MSDQAPKVPEEMFREVKYYAVGDIDPQVIQLLKAGKAKEVSYNALASHIISEDGDNPEVGEAREVFDLPVVKPSWVILSVQCGTLLPVNGFSPESCQIFFGITACLSQGVDTSWSSLLESSRALPGRGREGSLSSRSWEAQRSSAFF

SEQ ID NO: 61505 - protein, 815 aa, Homo sapiens
  Payload ID: 12282
  Gene Symbol: PAXBP1
  Gene Name: PAX3 and PAX7 binding protein 1
  Uniprot ID: Q9Y5B6
  ENSP ID: ENSP00000290178
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSNKALMAPNLDSFGRDRALYQEHAKRRIAEREARRTRRRQAREQTGKMADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKVIKPPFQRGSCPIPRRKECCSERPRRIWTDRPCVVFS

SEQ ID NO: 61506 - protein, 917 aa, Homo sapiens
  Payload ID: 12282
  Gene Symbol: PAXBP1
  Gene Name: PAX3 and PAX7 binding protein 1
  Uniprot ID: Q9Y5B6
  ENSP ID: ENSP00000328992
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSNKALMAPNLDSFGRDRALYQEHAKRRIAEREARRTRRRQAREQTGKMADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVIAENMWDPFSTTQTSRMVGITLKLINGYPSVVNAENKNTQVYLKALLLRMRRTLDDDVFMPLYPKNVLENKNSGPYLFFQRQFWSSVKLLGNFLQWYGIFSNKTLQELSIDGLLNRYILMAFQNSEYGDDSIKKAQNVINCFPKQWFMNLKGERTISQLENFCRYLVHLADTIYRNSIGCSDVEKRNARENIKQIVKLLASVRALDHAMSVASDHNVKEFKSLIEGK

SEQ ID NO: 61507 - protein, 36 aa, Homo sapiens
  Payload ID: 12282
  Gene Symbol: PAXBP1
  Gene Name: PAX3 and PAX7 binding protein 1
  ENSP ID: ENSP00000388973
YKQRASRLVQRRQDDIKDESSEFSSHSSQSILKTKL

SEQ ID NO: 61508 - protein, 511 aa, Homo sapiens
  Payload ID: 12282
  Gene Symbol: PAXBP1
  Gene Name: PAX3 and PAX7 binding protein 1
  Uniprot ID: Q9Y5B6
  ENSP ID: ENSP00000393038
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAESEQPLDKTGHVKDTNQEDGVIISEHGEDEMDMESEKEEEKPKTGGAFSNALSSLNVLRPGEIPDAAFIHAARKKRQMARELGDFTPHDNEPGKGRLVREDENDASDDEDDDEKRRIVFSVKEKSQRQKIAEEIGIEGSDDDALVTGEQDEELSRWEQEQIRKGINIPQVQASQPAEVNMYYQNTYQTMPYGSSYGIPYSYTAYGSSDAKSQKTDNTVPFKTPSNEMTPVTIDLVKKQLKDRLDSMKELHKTNRQQHEKHLQSRVDSTRAIERLEGSSGGIGERYKFLQEMRGYVQDLLECFSEKVPLINELESAIHQLYKQRASRLVQRRQDDIKDESSEFSSHSSQSILKTKL

SEQ ID NO: 61509 - protein, 25 aa, Homo sapiens
  Payload ID: 12282
  Gene Symbol: PAXBP1
  Gene Name: PAX3 and PAX7 binding protein 1
  ENSP ID: ENSP00000408048
QFWSSVKEKVISEFQSKVHRTQRNA

SEQ ID NO: 61510 - protein, 157 aa, Homo sapiens
  Payload ID: 12282
  Gene Symbol: PAXBP1
  Gene Name: PAX3 and PAX7 binding protein 1
  Uniprot ID: Q9Y5B6
  ENSP ID: ENSP00000458262
MFRKARRVNVRKRNDSEEEERERDEEQEPPPLLPPPGTGEEAGPGGGDRAPGGESLLGPGPSPPSALTPGLGAEAGGGFPGGAEPGNGLKPRKRPRENKEVPRASLLSFQDEEEENEEVFKVKKSSYSKKIVKLLKKEYKEDLEKSKIKTELNSSAE

SEQ ID NO: 61511 - protein, 157 aa, Homo sapiens; identical to SEQ ID NO: 61510
  Payload ID: 12282
  Gene Symbol: PAXBP1
  Gene Name: PAX3 and PAX7 binding protein 1
  Uniprot ID: Q9Y5B6
  ENSP ID: ENSP00000458892

SEQ ID NO: 61512 - protein, 591 aa, Homo sapiens
  Payload ID: 12283
  Gene Symbol: PXN
  Gene Name: paxillin
  Uniprot ID: P49023
  ENSP ID: ENSP00000228307
MDDLDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKIQGLEQRADGERCWAAGWPRDGGRSSPGGQDEGGFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 61513 - protein, 605 aa, Homo sapiens
  Payload ID: 12283
  Gene Symbol: PXN
  Gene Name: paxillin
  Uniprot ID: P49023
  ENSP ID: ENSP00000267257
MDDLDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKGSWPLEEVVLLVSISSSVQEGEKYPHPCAARHRTPSLRSPDQPPPCPQFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 61514 - protein, 557 aa, Homo sapiens
  Payload ID: 12283
  Gene Symbol: PXN
  Gene Name: paxillin
  Uniprot ID: P49023
  ENSP ID: ENSP00000391283
MDDLDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 61515 - protein, 424 aa, Homo sapiens
  Payload ID: 12283
  Gene Symbol: PXN
  Gene Name: paxillin
  Uniprot ID: P49023
  ENSP ID: ENSP00000395536
MSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 61516 - protein, 176 aa, Homo sapiens
  Payload ID: 12283
  Gene Symbol: PXN
  Gene Name: paxillin
  ENSP ID: ENSP00000443745
MAGNKDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPG

SEQ ID NO: 61517 - protein, 589 aa, Homo sapiens
  Payload ID: 12283
  Gene Symbol: PXN
  Gene Name: paxillin
  ENSP ID: ENSP00000443887
MADALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKIQGLEQRADGERCWAAGWPRDGGRSSPGGQDEGGFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 61518 - protein, 36 aa, Homo sapiens
  Payload ID: 12283
  Gene Symbol: PXN
  Gene Name: paxillin
  ENSP ID: ENSP00000446607
MSTSLGSNLSELDRLLLELNAVQHNPPGFPADEANS

SEQ ID NO: 61519 - protein, 31 aa, Homo sapiens
  Payload ID: 12283
  Gene Symbol: PXN
  Gene Name: paxillin
  ENSP ID: ENSP00000446650
MSTSLGSNLSELDRLLLELNAVQHNPPGFPA

SEQ ID NO: 61520 - protein, 91 aa, Homo sapiens
  Payload ID: 12283
  Gene Symbol: PXN
  Gene Name: paxillin
  ENSP ID: ENSP00000446893
MDDLDSEFQTGTSLAAARPCQEGTQCQVPDSQRRPAGGLGVYHLPHLQTACVLVGGDPLLIPNWKPHIPGDCRATPRPPTPVQRGPQWHNP

SEQ ID NO: 61521 - protein, 37 aa, Homo sapiens
  Payload ID: 12283
  Gene Symbol: PXN
  Gene Name: paxillin
  ENSP ID: ENSP00000447180
MSTSLGSNLSELDRLLLELNAVQHNPPGFPADEANSS

SEQ ID NO: 61522 - protein, 171 aa, Homo sapiens
  Payload ID: 12283
  Gene Symbol: PXN
  Gene Name: paxillin
  ENSP ID: ENSP00000449198
  MOD_RES (1)..(1): Any amino acid
XSRKEATPEGRPETCLLPSSPQAQRPIQGLEQRADGERCWAAGWPRDGGRSSPGGQDEGGFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNG

SEQ ID NO: 61523 - protein, 254 aa, Homo sapiens
  Payload ID: 12284
  Gene Symbol: PAGR1
  Gene Name: PAXIP1 associated glutamate-rich protein 1
  Uniprot ID: Q9BTK6
  ENSP ID: ENSP00000326519
MSLARGHGDTAASTAAPLSEEGEVTSGLQALAVEDTGGPSASAGKAEDEGEGGREETEREGSGGEEAQGEVPSAGGEEPAEEDSEDWCVPCSDEEVELPADGQPWMPPPSEIQRLYELLAAHGTLELQAEILPRRPPTPEAQSEEERSDEEPEAKEEEEEKPHMPTEFDFDDEPVTPKDSLIDRRRTPGSSARSQKREARLDKVLSDMKRHKKLEEQILRTGRDLFSLDSEDPSPASPPLRSSGSSLFPRQRKY

SEQ ID NO: 61524 - protein, 436 aa, Homo sapiens
  Payload ID: 12285
  Gene Symbol: PKNOX1
  Gene Name: PBX/knotted 1 homeobox 1
  Uniprot ID: P55347
  ENSP ID: ENSP00000291547
MMATQTLSIDSYQDGQQMQVVTELKTEQDPNCSEPDAEGVSPPPVESQTPMDVDKQAIYRHPLFPLLALLFEKCEQSTQGSEGTTSASFDVDIENFVRKQEKEGKPFFCEDPETDNLMVKAIQVLRIHLLELEKVNELCKDFCSRYIACLKTKMNSETLLSGEPGSPYSPVQSQQIQSAITGTISPQGIVVPASALQQGNVAMATVAGGTVYQPVTVVTPQGQVVTQTLSPGTIRIQNSQLQLQLNQDLSILHQDDGSSKNKRGVLPKHATNVMRSWLFQHIGHPYPTEDEKKQIAAQTNLTLLQVNNWFINARRRILQPMLDSSCSETPKTKKKTAQNRPVQRFWPDSIASGVAQPPPSELTMSEGAVVTITTPVNMNVDSLQSLSSDGATLAVQQVMMAGQSEDESVDSTEEDAGALAPAHISGLVLENSDSLQ

SEQ ID NO: 61525 - protein, 319 aa, Homo sapiens
  Payload ID: 12285
  Gene Symbol: PKNOX1
  Gene Name: PBX/knotted 1 homeobox 1
  ENSP ID: ENSP00000402243
MVKAIQVLRIHLLELEKVNELCKDFCSRYIACLKTKMNSETLLSGEPGSPYSPVQSQQIQSAITGTISPQGIVVPASALQQGNVAMATVAGGTVYQPVTVVTPQGQVVTQTLSPGTIRIQNSQLQLQLNQDLSILHQDDGSSKNKRGVLPKHATNVMRSWLFQHIGHPYPTEDEKKQIAAQTNLTLLQVNNWFINARRRILQPMLDSSCSETPKTKKKTAQNRPVQRFWPDSIASGVAQPPPSELTMSEGAVVTITTPVNMNVDSLQSLSSDGATLAVQQVMMAGQSEDESVDSTEEDAGALAPAHISGLVLENSDSLQ

SEQ ID NO: 61526 - protein, 61 aa, Homo sapiens
  Payload ID: 12285
  Gene Symbol: PKNOX1
  Gene Name: PBX/knotted 1 homeobox 1
  ENSP ID: ENSP00000453486
MMATQTLSIDSYQDGQQMQVVTELKTEQDPNCSEPDAEGVSPPPVESQTPMDVDKQAIYRW

SEQ ID NO: 61527 - protein, 472 aa, Homo sapiens
  Payload ID: 12286
  Gene Symbol: PKNOX2
  Gene Name: PBX/knotted 1 homeobox 2
  Uniprot ID: Q96KN3
  ENSP ID: ENSP00000298282
MMQHASPAPALTMMATQNVPPPPYQDSPQMTATAQPPSKAQAVHISAPSAAASTPVPSAPIDPQAQLEADKRAVYRHPLFPLLTLLFEKCEQATQGSECITSASFDVDIENFVHQQEQEHKPFFSDDPELDNLMVKAIQVLRIHLLELEKVNELCKDFCNRYITCLKTKMHSDNLLRNDLGGPYSPNQPSINLHSQDLLQNSPNSMSGVSNNPQGIVVPASALQQGNIAMTTVNSQVVSGGALYQPVTMVTSQGQVVTQAIPQGAIQIQNTQVNLDLTSLLDNEDKKSKNKRGVLPKHATNIMRSWLFQHLMHPYPTEDEKRQIAAQTNLTLLQVNNWFINARRRILQPMLDASNPDPAPKAKKIKSQHRPTQRFWPNSIAAGVLQQQGGAPGTNPDGSINLDNLQSLSSDSATMAMQQAMMAAHDDSLDGTEEEDEDEMEEEEEEELEEEVDELQTTNVSDLGLEHSDSLE

SEQ ID NO: 61528 - protein, 39 aa, Homo sapiens
  Payload ID: 12286
  Gene Symbol: PKNOX2
  Gene Name: PBX/knotted 1 homeobox 2
  ENSP ID: ENSP00000431599
MMQHASPAPALTMMATQNVPPPPYQDSPQMTATAQPPSK

SEQ ID NO: 61529 - protein, 40 aa, Homo sapiens
  Payload ID: 12286
  Gene Symbol: PKNOX2
  Gene Name: PBX/knotted 1 homeobox 2
  ENSP ID: ENSP00000434255
MMQHASPAPALTMMATQNVPPPPYQDSPQMTATAQPPSKA

SEQ ID NO: 61530 - protein, 40 aa, Homo sapiens
  Payload ID: 12286
  Gene Symbol: PKNOX2
  Gene Name: PBX/knotted 1 homeobox 2
  ENSP ID: ENSP00000434377
MMQHASPAPALTMMATQNVPPPPYQDSPQAPSFPAPDAAV

SEQ ID NO: 61531 - protein, 98 aa, Homo sapiens
  Payload ID: 12286
  Gene Symbol: PKNOX2
  Gene Name: PBX/knotted 1 homeobox 2
  ENSP ID: ENSP00000453374
MMQHASPAPALTMMATQNVPPPPYQDSPQMTATAQPPSKAQAVHISAPSAAASTPVPSAPIDPQAQLEADKRAVYRHPLFPLLTLLFEKCEQATQGSE

SEQ ID NO: 61532 - protein, 329 aa, Homo sapiens
  Payload ID: 12287
  Gene Symbol: PSIP1
  Gene Name: PC4 and SFRS1 interacting protein 1
  Uniprot ID: O75475
  ENSP ID: ENSP00000370091
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEHFAL

SEQ ID NO: 61533 - protein, 333 aa, Homo sapiens
  Payload ID: 12287
  Gene Symbol: PSIP1
  Gene Name: PC4 and SFRS1 interacting protein 1
  Uniprot ID: O75475
  ENSP ID: ENSP00000370092
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEHQTTCNLQ

SEQ ID NO: 61534 - protein, 530 aa, Homo sapiens
  Payload ID: 12287
  Gene Symbol: PSIP1
  Gene Name: PC4 and SFRS1 interacting protein 1
  Uniprot ID: O75475
  ENSP ID: ENSP00000370109
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKKPSSEERETEISLKDSTLDN

SEQ ID NO: 61535 - protein, 530 aa, Homo sapiens; identical to SEQ ID NO: 61534
  Payload ID: 12287
  Gene Symbol: PSIP1
  Gene Name: PC4 and SFRS1 interacting protein 1
  Uniprot ID: O75475
  ENSP ID: ENSP00000370114

SEQ ID NO: 61536 - protein, 333 aa, Homo sapiens; identical to SEQ ID NO: 61533
  Payload ID: 12287
  Gene Symbol: PSIP1
  Gene Name: PC4 and SFRS1 interacting protein 1
  Uniprot ID: O75475
  ENSP ID: ENSP00000380653

SEQ ID NO: 61537 - protein, 65 aa, Homo sapiens
  Payload ID: 12287
  Gene Symbol: PSIP1
  Gene Name: PC4 and SFRS1 interacting protein 1
  ENSP ID: ENSP00000477077
KRKGGRNFQTAHRRNMLKGQHEKEAADRKRKQEEQMETEHINPVTEKRIQVEQTRDEDLDTDSLD

SEQ ID NO: 61538 - protein, 403 aa, Homo sapiens
  Payload ID: 12288
  Gene Symbol: PCED1A
  Gene Name: PC-esterase domain containing 1A
  Uniprot ID: Q9H1Q7
  ENSP ID: ENSP00000349334
MVFCLSSEEPRRPLRSDMVHFQASEVQQLLHNKFVVILGDSIQRAVYKDLVLLLQKDSLLTAAQLKAKYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 61539 - protein, 454 aa, Homo sapiens
  Payload ID: 12288
  Gene Symbol: PCED1A
  Gene Name: PC-esterase domain containing 1A
  Uniprot ID: Q9H1Q7
  ENSP ID: ENSP00000353868
MVFCLSSEEPRRPLRSDMVHFQASEVQQLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 61540 - protein, 229 aa, Homo sapiens
  Payload ID: 12288
  Gene Symbol: PCED1A
  Gene Name: PC-esterase domain containing 1A
  ENSP ID: ENSP00000388935
MVFCLSSEEPRRPLRSDMVHFQASEVQQLLHNKFVVILGDSIQRAVYKDLVLLLQKDSLLTAAQLKAKYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPP

SEQ ID NO: 61541 - protein, 280 aa, Homo sapiens
  Payload ID: 12288
  Gene Symbol: PCED1A
  Gene Name: PC-esterase domain containing 1A
  ENSP ID: ENSP00000401711
MVFCLSSEEPRRPLRSDMVHFQASEVQQLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPP

SEQ ID NO: 61542 - protein, 127 aa, Homo sapiens
  Payload ID: 12288
  Gene Symbol: PCED1A
  Gene Name: PC-esterase domain containing 1A
  ENSP ID: ENSP00000474824
  MOD_RES (1)..(1): Any amino acid
XHAVQHRHRDGVHWDQHAHRHLSHLLLTHVADAWGVELPKRGYPPGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 61543 - protein, 432 aa, Homo sapiens
  Payload ID: 12289
  Gene Symbol: PCED1B
  Gene Name: PC-esterase domain containing 1B
  Uniprot ID: Q96HM7
  ENSP ID: ENSP00000396040
MILLRASEVRQLLHNKFVVILGDSVHRAVYKDLVLLLQKDRLLTPGQLRARGELNFEQDELVDGGQRGHMHNGLNYREVREFRSDHHLVRFYFLTRVYSDYLQTILKELQSGEHAPDLVIMNSCLWDISRYGPNSWRSYLENLENLFQCLGQVLPESCLLVWNTAMPVGEEVTGGFLPPKLRRQKATFLKNEVVKANFHSATEARKHNFDVLDLHFHFRHARENLHWDGVHWNGRVHRCLSQLLLAHVADAWGVELPHRHPVGEWIKKKKPGPRVEGPPQANRNHPALPLSPPLPSPTYRPLLGFPPQRLPLLPLLSPQPPPPILHHQGMPRFPQGPPDACFSSDHTFQSDQFYCHSDVPSSAHAGFFVEDNFMVGPQLPMPFFPTPRYQRPAPVVHRGFGRYRPRGPYTPWGQRPRPSKRRAPANPEPRPQ

SEQ ID NO: 61544 - protein, 432 aa, Homo sapiens; identical to SEQ ID NO: 61543
  Payload ID: 12289
  Gene Symbol: PCED1B
  Gene Name: PC-esterase domain containing 1B
  Uniprot ID: Q96HM7
  ENSP ID: ENSP00000446688

SEQ ID NO: 61545 - protein, 167 aa, Homo sapiens
  Payload ID: 12289
  Gene Symbol: PCED1B
  Gene Name: PC-esterase domain containing 1B
  ENSP ID: ENSP00000448000
MILLRASEVRQLLHNKFVVILGDSVHRAVYKDLVLLLQKDRLLTPGQLRARGELNFEQDELVDGGQRGHMHNGLNYREVREFRSDHHLVRFYFLTRVYSDYLQTILKELQSGEHAPDLVIMNSCLWDISRYGPNSWRSYLENLENLFQCLGQVLPESCLLVWNTAMP

SEQ ID NO: 61546 - protein, 189 aa, Homo sapiens
  Payload ID: 12289
  Gene Symbol: PCED1B
  Gene Name: PC-esterase domain containing 1B
  ENSP ID: ENSP00000448693
MNSCLWDISRYGPNSWRSYLENLENLFQCLGQVLPESCLLVWNTAMPVGEEVTGGFLPPKLRRQKATFLKNEVVKANFHSATEARKHNFDVLDLHFHFRHARENLHWDGVHWNGRVHRCLSQLLLAHVADAWGVELPHRHPVGEWIKKKKPGPRVEGPPQANRNHPALPLSPPLPSPTYRPLLGFPPQR

SEQ ID NO: 61547 - protein, 58 aa, Homo sapiens
  Payload ID: 12289
  Gene Symbol: PCED1B
  Gene Name: PC-esterase domain containing 1B
  ENSP ID: ENSP00000448926
MILLRASEVRQLLHNKFVVILGDSVHRAVYKDLVLLLQKDRLLTPGQLRARGELNFEQ

SEQ ID NO: 61548 - protein, 167 aa, Homo sapiens; identical to SEQ ID NO: 61545
  Payload ID: 12289
  Gene Symbol: PCED1B
  Gene Name: PC-esterase domain containing 1B
  ENSP ID: ENSP00000449680

SEQ ID NO: 61549 - protein, 1555 aa, Homo sapiens
  Payload ID: 12290
  Gene Symbol: PCF11
  Gene Name: PCF11 cleavage and polyadenylation factor subunit
  Uniprot ID: O94913
  ENSP ID: ENSP00000298281
MSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGVREEQRSPFNDRFPLKRPRYEDSDKPFVDSPASRFAGLDTNQRLTALAEDRPLFDGPSRPSVARDGPTKMIFEGPNKLSPRIDGPPTPASLRFDGSPGQMGGGGPLRFEGPQGQLGGGCPLRFEGPPGPVGTPLRFEGPIGQAGGGGFRFEGSPGLRFEGSPGGLRFEGPGGQPVGGLRFEGHRGQPVGGLRFEGPHGQPVGGLRFDNPRGQPVGGLRFEGGHGPSGAAIRFDGPHGQPGGGIRFEGPLLQQGVGMRFEGPHGQSVAGLRFEGQHNQLGGNLRFEGPHGQPGVGIRFEGPLVQQGGGMRFEGPSVPGGGLRIEGPLGQGGPRFEGCHALRFDGQPGQPSLLPRFDGLHGQPGPRFERTPGQPGPQRFDGPPGQQVQPRFDGVPQRFDGPQHQQASRFDIPLGLQGTRFDNHPSQRLESVSFNQTGPYNDPPGNAFNAPSQGLQFQRHEQIFDSPQGPNFNGPHGPGNQSFSNPLNRASGHYFDEKNLQSSQFGNFGNIPAPMTVGNIQASQQVLSGVAQPVAFGQGQQFLPVHPQNPGFVQNPSGALPKAYPDNHLSQVDVNELFSKLLKTGILKLSQTDSATTQVSEVTAQPPPEEEEDQNEDQDVPDLTNFTVEELKQRYDSVINRLYTGIQCYSCGMRFTTSQTDVYADHLDWHYRQNRTEKDVSRKVTHRRWYYSLTDWIEFEEIADLEERAKSQFFEKVHEEVVLKTQEAAKEKEFQSVPAGPAGAVESCEICQEQFEQYWDEEEEEWHLKNAIRVDGKIYHPSCYEDYQNTSSFDCTPSPSKTPVENPLNIMLNIVKNELQEPCDSPKVKEERIDTPPACTEESIATPSEIKTENDTVESV

SEQ ID NO: 61550 - protein, 784 aa, Homo sapiens
  Payload ID: 12290
  Gene Symbol: PCF11
  Gene Name: PCF11 cleavage and polyadenylation factor subunit
  ENSP ID: ENSP00000431567
MSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGVREEQRSPFNDRFPLKRPRYEDSDKPFVDSPASRFAGLDTNQRLTALAEDRPLFDGPSRPSVARDGPTKMIFEGPNKLSPRIDGPP

SEQ ID NO: 61551 - protein, 998 aa, Homo sapiens
  Payload ID: 12290
  Gene Symbol: PCF11
  Gene Name: PCF11 cleavage and polyadenylation factor subunit
  ENSP ID: ENSP00000434540
MSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGKHRCNVRDSPTEENKGGLKKKPLLSDAELTYYEHKAKLKRTQVQHSFPRLDLLDPDIFDYPLTDALLSGIECEPSKSKHASRNSGAQFDRKEQFSERARRLSPISGSRTYAENLSPHEGRRRHDEQVSAKGVREEQRSPFNDRFPLKRPRYEDSDKPFVDSPASRFAGLDTNQRLTALAEDRPLFDGPSRPSVARDGPTKMIFEGPNKLSPRIDGPPTPASLRFDGSPGQMGGGGPLRFEGPQGQLGGGCPLRFEGPPGPVGTPLRFEGPIGQAGGGGFRFEGSPGLRFEGSPGGLRFEG

SEQ ID NO: 61552 - protein, 99 aa, Homo sapiens
  Payload ID: 12290
  Gene Symbol: PCF11
  Gene Name: PCF11 cleavage and polyadenylation factor subunit
  ENSP ID: ENSP00000436806
MSEQTPAEAGAAGAREDACRDYQSSLEDLTFNSKPHINMLTILAEENLPFAKEIVSLIEAQTAKVDENTRKSLFKLRSTWDEIFPLKKLYALDVRVNSL

SEQ ID NO: 61553 - protein, 198 aa, Homo sapiens
  Payload ID: 12290
  Gene Symbol: PCF11
  Gene Name: PCF11 cleavage and polyadenylation factor subunit
  ENSP ID: ENSP00000437076
MLTCLVLSGVAQPVAFGQGQQFLPVHPQNPGFVQNPSGALPKAYPDNHLSQVDVNELFSKLLKTGILKLSQTDSATTQVSEVTAQPPPEEEEDQNEDQDVPDLTNFTVEELKQRYDSVINRLYTGIQCYSCGMRFTTSQTDVYADHLDWHYRQNRTEKDVSRKVTHRRWYYSLTDWIEFEEIADLEERAKSQFFEKVH

SEQ ID NO: 61554 - protein, 725 aa, Homo sapiens
  Payload ID: 12290
  Gene Symbol: PCF11
  Gene Name: PCF11 cleavage and polyadenylation factor subunit
  ENSP ID: ENSP00000479505
MSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGVREEQRSPFNDRFHLSDLDMKIQINHL

SEQ ID NO: 61555 - protein, 453 aa, Homo sapiens
  Payload ID: 12291
  Gene Symbol: PCID2
  Gene Name: PCI domain containing 2
  Uniprot ID: Q5JVF3
  ENSP ID: ENSP00000246505
MAHITINQYLQQVYEAIDSRDGASCAELVSFKHPHVANPRLQMASPEEKCQQVLEPPYDEMFAAHLRCTYAVGNHDFIEAYKCQTVIVQYPLSFMAAVPHRTHAVDYLGLETRKHWASCSFLQLERNDSVLEQKLVSALSLGTSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 61556 - protein, 399 aa, Homo sapiens
  Payload ID: 12291
  Gene Symbol: PCID2
  Gene Name: PCI domain containing 2
  Uniprot ID: Q5JVF3
  ENSP ID: ENSP00000337405
MAHITINQYLQQVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 61557 - protein, 397 aa, Homo sapiens
  Payload ID: 12291
  Gene Symbol: PCID2
  Gene Name: PCI domain containing 2
  Uniprot ID: Q5JVF3
  ENSP ID: ENSP00000364606
MRLTDVVQQLVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 61558 - protein, 397 aa, Homo sapiens; identical to SEQ ID NO: 61557
  Payload ID: 12291
  Gene Symbol: PCID2
  Gene Name: PCI domain containing 2
  Uniprot ID: Q5JVF3
  ENSP ID: ENSP00000364608

SEQ ID NO: 61559 - protein, 399 aa, Homo sapiens; identical to SEQ ID NO: 61556
  Payload ID: 12291
  Gene Symbol: PCID2
  Gene Name: PCI domain containing 2
  Uniprot ID: Q5JVF3
  ENSP ID: ENSP00000364626

SEQ ID NO: 61560 - protein, 399 aa, Homo sapiens; identical to SEQ ID NO: 61556
  Payload ID: 12291
  Gene Symbol: PCID2
  Gene Name: PCI domain containing 2
  Uniprot ID: Q5JVF3
  ENSP ID: ENSP00000364628

SEQ ID NO: 61561 - protein, 453 aa, Homo sapiens; identical to SEQ ID NO: 61555
  Payload ID: 12291
  Gene Symbol: PCID2
  Gene Name: PCI domain containing 2
  Uniprot ID: Q5JVF3
  ENSP ID: ENSP00000479494

SEQ ID NO: 61562 - protein, 181 aa, Homo sapiens
  Payload ID: 12292
  Gene Symbol: PDAP1
  Gene Name: PDGFA associated protein 1
  Uniprot ID: Q13442
  ENSP ID: ENSP00000222968
MPKGGRKGGHKGRARQYTSPEEIDAQLQAEKQKAREEEEQKEGGDGAAGDPKKEKKSLDSDESEDEEDDYQQKRKGVEGLIDIENPNRVAQTTKKVTQLDLDGPKELSRREREEIEKQKAKERYMKMHLAGKTEQAKADLARLAIIRKQREEAARKKEEERKAKDDATLSGKRMQSLSLNK

SEQ ID NO: 61563 - protein, 39 aa, Homo sapiens
  Payload ID: 12292
  Gene Symbol: PDAP1
  Gene Name: PDGFA associated protein 1
  ENSP ID: ENSP00000411287
MPKGGRKGGHKGRARQYTSPEEIDAQLQAEKQKARVVHF

SEQ ID NO: 61564 - protein, 39 aa, Homo sapiens; identical to SEQ ID NO: 61563
  Payload ID: 12292
  Gene Symbol: PDAP1
  Gene Name: PDGFA associated protein 1
  ENSP ID: ENSP00000486021

SEQ ID NO: 61565 - protein, 341 aa, Homo sapiens
  Payload ID: 12293
  Gene Symbol: PDIK1L
  Gene Name: PDLIM1 interacting kinase 1 like
  Uniprot ID: Q8N165
  ENSP ID: ENSP00000363387
MVSSQPKYDLIREVGRGSYGVVYEAVIRKTSARVAVKKIRCHAPENVELALREFWALSSIKSQHPNVIHLEECILQKDGMVQKMSHGSNSSLYLQLVETSLKGEIAFDPRSAYYLWFVMDFCDGGDMNEYLLSRKPNRKTNTSFMLQLSSALAFLHKNQIIHRDLKPDNILISQTRLDTSDLEPTLKVADFGLSKVCSASGQNPEEPVSVNKCFLSTACGTDFYMAPEVWEGHYTAKADIFALGIIIWAMLERITFIDTETKKELLGSYVKQGTEIVPVGEALLENPKMELLIPVKKKSMNGRMKQLIKEMLAANPQDRPDAFELELRLVQIAFKDSSWET

SEQ ID NO: 61566 - protein, 341 aa, Homo sapiens; identical to SEQ ID NO: 61565
  Payload ID: 12293
  Gene Symbol: PDIK1L
  Gene Name: PDLIM1 interacting kinase 1 like
  Uniprot ID: Q8N165
  ENSP ID: ENSP00000363389

SEQ ID NO: 61567 - protein, 191 aa, Homo sapiens
  Payload ID: 12293
  Gene Symbol: PDIK1L
  Gene Name: PDLIM1 interacting kinase 1 like
  ENSP ID: ENSP00000406510
MVSSQPKYDLIREVGRGSYGVVYEAVIRKTSARVAVKKIRCHAPENVELALREFWALSSIKSQHPNVIHLEECILQKDGMVQKMSHGSNSSLYLQLVETSLKGEIAFDPRSAYYLWFVMDFCDGGDMNEYLLSRKPNRKTNTSFMLQLSSALAFLHKNQIIHRDLKPDNILISQTRLDTSDLEPTLKVADF

SEQ ID NO: 61568 - protein, 341 aa, Homo sapiens; identical to SEQ ID NO: 61565
  Payload ID: 12293
  Gene Symbol: PDIK1L
  Gene Name: PDLIM1 interacting kinase 1 like
  Uniprot ID: Q8N165
  ENSP ID: ENSP00000480635

SEQ ID NO: 61569 - protein, 1337 aa, Homo sapiens
  Payload ID: 12294
  Gene Symbol: PDS5A
  Gene Name: PDS5 cohesin associated factor A
  Uniprot ID: Q29RF7
  ENSP ID: ENSP00000303427
MDFTAQPKPATALCGVVSADGKIAYPPGVKEITDKITTDEMIKRLKMVVKTFMDMDQDSEDEKQQYLPLALHLASEFFLRNPNKDVRLLVACCLADIFRIYAPEAPYTSHDKLKDIFLFITRQLKGLEDTKSPQFNRYFYLLENLAWVKSYNICFELEDCNEIFIQLFRTLFSVINNSHNKKVQMHMLDLMSSIIMEGDGVTQELLDSILINLIPAHKNLNKQSFDLAKVLLKRTVQTIEACIANFFNQVLVLGRSSVSDLSEHVFDLIQELFAIDPHLLLSVMPQLEFKLKSNDGEERLAVVRLLAKLFGSKDSDLATQNRPLWQCFLGRFNDIHVPVRLESVKFASHCLMNHPDLAKDLTEYLKVRSHDPEEAIRHDVIVTIITAAKRDLALVNDQLLGFVRERTLDKRWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVREIARKLANPKQPTNPFLEMVKFLLERIAPVHIDSEAISALVKLMNKSIEGTADDEEEGVSPDTAIRSGLELLKVLSFTHPTSFHSAETYESLLQCLRMEDDKVAEAAIQIFRNTGHKIETDLPQIRSTLIPILHQKAKRGTPHQAKQAVHCIHAIFTNKEVQLAQIFEPLSRSLNADVPEQLITPLVSLGHISMLAPDQFASPMKSVVANFIVKDLLMNDRSTGEKNGKLWSPDEEVSPEVLAKVQAIKLLVRWLLGMKNNQSKSANSTLRLLSAMLVSEGDLTEQKRISKSDMSRLRLAAGSAIMKLAQEPCYHEIITPEQFQLCALVINDECYQVRQIFAQKLHKALVKLLLPLEYMAIFALCAKDPVKERRAHARQCLLKNISIRREYIKQNPMATEKLLSLLPEYVVPYMIHLLAHDPDFTRSQDVDQLRDIKECLWFMLEVLMTKNENNSHAFMKKMAENIKLTRDAQSPDESKTNEKLYTVCDVALCVINSKSALCNADSPKDPVLPMKFFTQPEKDFCNDKSYISEETRVLLLTGKPKPAGVLGAVNKPLSATGRKPYVRSTGTETGSNINVNSELNPSTGNRSREQSSEAAETGVSENEENPVRIISVTPVKNIDPVKNKEINSDQATQGNISSDRGKKRTVTAAGAENIQQKTDEKVDESGPPAPSKPRRGRRPKSESQGNATKNDDLNKPINKGRKRAAVGQESPGGLEAGNAKAPKLQDLAKKAAPAERQIDLQR

SEQ ID NO: 61570 - protein, 126 aa, Homo sapiens
  Payload ID: 12294
  Gene Symbol: PDS5A
  Gene Name: PDS5 cohesin associated factor A
  ENSP ID: ENSP00000424510
LIPILHQKAKRGTPHQAKQAVHCIHAIFTNKEVQLAQIFEPLSRSLNADVPEQLITPLVSLGHISMLAPDQFASPMKSVVANFIVKDLLMNDRSTGEKNGKLWSPDEEVSPEVLAKHFGRQSRRIA

SEQ ID NO: 61571 - protein, 165 aa, Homo sapiens
  Payload ID: 12294
  Gene Symbol: PDS5A
  Gene Name: PDS5 cohesin associated factor A
  ENSP ID: ENSP00000424531
  MOD_RES (1)..(1): Any amino acid
XLPLALHLASEFFLRNPNKDVRLLVACCLADIFRIYAPEAPYTSHDKLKWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPT

SEQ ID NO: 61572 - protein, 43 aa, Homo sapiens
  Payload ID: 12294
  Gene Symbol: PDS5A
  Gene Name: PDS5 cohesin associated factor A
  ENSP ID: ENSP00000425386
SNDGEERLAVVRLLAKLFGSKDSDLATQNRPLWQCFLGRIFKG

SEQ ID NO: 61573 - protein, 600 aa, Homo sapiens
  Payload ID: 12294
  Gene Symbol: PDS5A
  Gene Name: PDS5 cohesin associated factor A
  Uniprot ID: Q29RF7
  ENSP ID: ENSP00000426749
MDFTAQPKPATALCGVVSADGKIAYPPGVKEITDKITTDEMIKRLKMVVKTFMDMDQDSEDEKQQYLPLALHLASEFFLRNPNKDVRLLVACCLADIFRIYAPEAPYTSHDKLKDIFLFITRQLKGLEDTKSPQFNRYFYLLENLAWVKSYNICFELEDCNEIFIQLFRTLFSVINNSHNKKVQMHMLDLMSSIIMEGDGVTQELLDSILINLIPAHKNLNKQSFDLAKVLLKRTVQTIEACIANFFNQVLVLGRSSVSDLSEHVFDLIQELFAIDPHLLLSVMPQLEFKLKSNDGEERLAVVRLLAKLFGSKDSDLATQNRPLWQCFLGRFNDIHVPVRLESVKFASHCLMNHPDLAKDLTEYLKVRSHDPEEAIRHDVIVTIITAAKRDLALVNDQLLGFVRERTLDKRWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVVSKSYFTLFL

SEQ ID NO: 61574 - protein, 1447 aa, Homo sapiens
  Payload ID: 12295
  Gene Symbol: PDS5B
  Gene Name: PDS5 cohesin associated factor B
  Uniprot ID: Q9NTI5
  ENSP ID: ENSP00000313851
MAHSKTRTNDGKITYPPGVKEISDKISKEEMVRRLKMVVKTFMDMDQDSEEEKELYLNLALHLASDFFLKHPDKDVRLLVACCLADIFRIYAPEAPYTSPDKLKDIFMFITRQLKGLEDTKSPQFNRYFYLLENIAWVKSYNICFELEDSNEIFTQLYRTLFSVINNGHNQKVHMHMVDLMSSIICEGDTVSQELLDTVLVNLVPAHKNLNKQAYDLAKALLKRTAQAIEPYITNFFNQVLMLGKTSISDLSEHVFDLILELYNIDSHLLLSVLPQLEFKLKSNDNEERLQVVKLLAKMFGAKDSELASQNKPLWQCYLGRFNDIHVPIRLECVKFASHCLMNHPDLAKDLTEYLKVRSHDPEEAIRHDVIVSIVTAAKKDILLVNDHLLNFVRERTLDKRWRVRKEAMMGLAQIYKKYALQSAAGKDAAKQIAWIKDKLLHIYYQNSIDDRLLVERIFAQYMVPHNLETTERMKCLYYLYATLDLNAVKALNEMWKCQNLLRHQVKDLLDLIKQPKTDASVKAIFSKVMVITRNLPDPGKAQDFMKKFTQVLEDDEKIRKQLEVLVSPTCSCKQAEGCVREITKKLGNPKQPTNPFLEMIKFLLERIAPVHIDTESISALIKQVNKSIDGTADDEDEGVPTDQAIRAGLELLKVLSFTHPISFHSAETFESLLACLKMDDEKVAEAALQIFKNTGSKIEEDFPHIRSALLPVLHHKSKKGPPRQAKYAIHCIHAIFSSKETQFAQIFEPLHKSLDPSNLEHLITPLVTIGHIALLAPDQFAAPLKSLVATFIVKDLLMNDRLPGKKTTKLWVPDEEVSPETMVKIQAIKMMVRWLLGMKNNHSKSGTSTLRLLTTILHSDGDLTEQGKISKPDMSRLRLAAGSAIVKLAQEPCYHEIITLEQYQLCALAINDECYQVRQVFAQKLHKGLSRLRLPLEYMAICALCAKDPVKERRAHARQCLVKNINVRREYLKQHAAVSEKLLSLLPEYVVPYTIHLLAHDPDYVKVQDIEQLKDVKECLWFVLEILMAKNENNSHAFIRKMVENIKQTKDAQGPDDAKMNEKLYTVCDVAMNIIMSKSTTYSLESPKDPVLPARFFTQPDKNFSNTKNYLPPEMKSFFTPGKPKTTNVLGAVNKPLSSAGKQSQTKSSRMETVSNASSSSNPSSPGRIKGRLDSSEMDHSENEDYTMSSPLPGKKSDKRDDSDLVRSELEKPRGRKKTPVTEQEEKLGMDDLTKLVQEQKPKGSQRSRKRGHTASESDEQQWPEEKRLKEDILENEDEQNSPPKKGKRGRPPKPLGGGTPKEEPTMKTSKKGSKKKSGPPAPEEEEEEERQSGNTEQKSKSKQHRVSRRAQQRAESPESSAIESTQSTPQKGRGRPSKTPSPSQPKKNVRVGRSKQAATKENDSSEEVDVFQGSSPVDDIPQEETEEEEVSTVNVRRRSAKRERR

SEQ ID NO: 61575 - protein, 1391 aa, Homo sapiens
  Payload ID: 12295
  Gene Symbol: PDS5B
  Gene Name: PDS5 cohesin associated factor B
  Uniprot ID: Q9NTI5
  ENSP ID: ENSP00000401619
MAHSKTRTNDGKITYPPGVKEISDKISKEEMVRRLKMVVKTFMDMDQDSEEEKELYLNLALHLASDFFLKHPDKDVRLLVACCLADIFRIYAPEAPYTSPDKLKDIFMFITRQLKGLEDTKSPQFNRYFYLLENIAWVKSYNICFELEDSNEIFTQLYRTLFSVINNGHNQKVHMHMVDLMSSIICEGDTVSQELLDTVLVNLVPAHKNLNKQAYDLAKALLKRTAQAIEPYITNFFNQVLMLGKTSISDLSEHVFDLILELYNIDSHLLLSVLPQLEFKLKSNDNEERLQVVKLLAKMFGAKDSELASQNKPLWQCYLGRFNDIHVPIRLECVKFASHCLMNHPDLAKDLTEYLKVRSHDPEEAIRHDVIVSIVTAAKKDILLVNDHLLNFVRERTLDKRWRVRKEAMMGLAQIYKKYALQSAAGKDAAKQIAWIKDKLLHIYYQNSIDDRLLVERIFAQYMVPHNLETTERMKCLYYLYATLDLNAVKALNEMWKCQNLLRHQVKDLLDLIKQPKTDASVKAIFSKVMVITRNLPDPGKAQDFMKKFTQVLEDDEKIRKQLEVLVSPTCSCKQAEGCVREITKKLGNPKQPTNPFLEMIKFLLERIAPVHIDTESISALIKQVNKSIDGTADDEDEGVPTDQAIRAGLELLKVLSFTHPISFHSAETFESLLACLKMDDEKVAEAALQIFKNTGSKIEEDFPHIRSALLPVLHHKSKKGPPRQAKYAIHCIHAIFSSKETQFAQIFEPLHKSLDPSNLEHLITPLVTIGHIALLAPDQFAAPLKSLVATFIVKDLLMNDRLPGKKTTKLWVPDEEVSPETMVKIQAIKMMVRWLLGMKNNHSKSGTSTLRLLTTILHSDGDLTEQGKISKPDMSRLRLAAGSAIVKLAQEPCYHEIITLEQYQLCALAINDECYQVRQVFAQKLHKGLSRLRLPLEYMAICALCAKDPVKERRAHARQCLVKNINVRREYLKQHAAVSEKLLSLLPEYVVPYTIHLLAHDPDYVKVQDIEQLKDVKECLWFVLEILMAKNENNSHAFIRKMVENIKQTKDAQGPDDAKMNEKLYTVCDVAMNIIMSKSTTYSLESPKDPVLPARFFTQPDKNFSNTKNYLPPEMKSFFTPGKPKTTNVLGAVNKPLSSAGKQSQTKSSRMETVSNASSSSNPSSPGRIKGRLDSSEMDHSENEDYTMSSPLPGKKSDKRDDSDLVRSELEKPRGRKKTPVTEQEEKLGMDDLTKLVQEQKPKGSQRSRKRGHTASESDEQQWPEEKRLKEDILENEDEQNSPPKKGKRGRPPKPLGGGTPKEEPTMKTSKKGSKKKSGPPAPEEEEEEERQSGNTEQKSKSKQHRVSRRAQQRAESPESSAIESTQSTPQKGRGRPSKTPSPSQPKKNV

SEQ ID NO: 61576 - protein, 302 aa, Homo sapiens
  Payload ID: 12295
  Gene Symbol: PDS5B
  Gene Name: PDS5 cohesin associated factor B
  ENSP ID: ENSP00000407005
IKQTKDAQGPDDAKMNEKLYTVCDVAMNIIMSKSTTYSLESPKDPVLPARFFTQPDKNFSNTKNYLPPEMKSFFTPGKPKTTNVLGAVNKPLSSAGKQSQTKSSRMETVSNASSSSNPSSPGRIKGRLDSSEMDHSENEDYTMSSPLPGKKSDKRDDSDLSELEKPRGRKKTPVTEQEEKLGMDDLTKLVQEQKPKGSQRSRKRGHTASESDEQQWPEEKRLKEDILENEDEQNSPPKKGKRGRPPKPLGGGTPKEEPTMKTSKKGSKKKSGPPAPEEEEEEERQSGNTEQKSKSKQHRVSR

SEQ ID NO: 61577 - protein, 704 aa, Homo sapiens
  Payload ID: 12296
  Gene Symbol: PCIF1
  Gene Name: PDX1 C-terminal inhibiting factor 1
  Uniprot ID: Q9H4Z3
  ENSP ID: ENSP00000361486
MANENHGSPREEASLLSHSPGTSNQSQPCSPKPIRLVQDLPEELVHAGWEKCWSRRENRPYYFNRFTNQSLWEMPVLGQHDVISDPLGLNATPLPQDSSLVETPPAENKPRKRQLSEEQPSGNGVKKPKIEIPVTPTGQSVPSSPSIPGTPTLKMWGTSPEDKQQAALLRPTEVYWDLDIQTNAVIKHRGPSEVLPPHPEVELLRSQLILKLRQHYRELCQQREGIEPPRESFNRWMLERKVVDKGSDPLLPSNCEPVVSPSMFREIMNDIPIRLSRIKFREEAKRLLFKYAEAARRLIESRSASPDSRKVVKWNVEDTFSWLRKDHSASKEDYMDRLEHLRRQCGPHVSAAAKDSVEGICSKIYHISLEYVKRIREKHLAILKENNISEEVEAPEVEPRLVYCYPVRLAVSAPPMPSVEMHMENNVVCIRYKGEMVKVSRNYFSKLWLLYRYSCIDDSAFERFLPRVWCLLRRYQMMFGVGLYEGTGLQGSLPVHVFEALHRLFGVSFECFASPLNCYFRQYCSAFPDTDGYFGSRGPCLDFAPLSGSFEANPPFCEELMDAMVSHFERLLESSPEPLSFIVFIPEWREPPTPALTRMEQSRFKRHQLILPAFEHEYRSGSQHICKKEEMHYKAVHNTAVLFLQNDPGFAKWAPTPERLQELSAAYRQSGRSHSSGSSSSSSSEAKDRDSGREQGPSREPHPT

SEQ ID NO: 61578 - protein, 304 aa, Homo sapiens
  Payload ID: 12296
  Gene Symbol: PCIF1
  Gene Name: PDX1 C-terminal inhibiting factor 1
  ENSP ID: ENSP00000480607
  MOD_RES (1)..(1): Any amino acid
XLKENNISEEVEAPEVEPRLVYCYPVRLAVSAPPMPSVEMHMENNVVCIRYKGEMVKVSRNYFSKLWLLYRYSCIDDSAFERFLPRVWCLLRRYQMMFGVGLYEGTGLQGSLPVHVFEALHRLFGVSFECFASPLNCYFRQYCSAFPDTDGYFGSRGPCLDFAPLSGSFEANPPFCEELMDAMVSHFERLLESSPEPLSFIVFIPEWREPPTPALTRMEQSRFKRHQLILPAFEHEYRSGSQHICKKWVPGRAGEGGWAGQARPSPTLSHCLCPQGGNALQGRPQHGCALPTERPWLCQVGADA

SEQ ID NO: 61579 - protein, 329 aa, Homo sapiens
  Payload ID: 12297
  Gene Symbol: PDLIM1
  Gene Name: PDZ and LIM domain 1
  Uniprot ID: O00151
  ENSP ID: ENSP00000360305
MTTQQIDLQGPGPWGFRLVGGKDFEQPLAISRVTPGSKAALANLCIGDVITAIDGENTSNMTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 61580 - protein, 366 aa, Homo sapiens
  Payload ID: 12298
  Gene Symbol: PDLIM2
  Gene Name: PDZ and LIM domain 2 (mystique)
  Uniprot ID: Q96JY6
  ENSP ID: ENSP00000265810
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIANQAVRIQEGRYRHPGCYTCADCGLNLKMRGHFWEDACAMEGMRLSLEALEGMVEGAKRRDRRKTRRPIQPSW

SEQ ID NO: 61581 - protein, 602 aa, Homo sapiens
  Payload ID: 12298
  Gene Symbol: PDLIM2
  Gene Name: PDZ and LIM domain 2 (mystique)
  Uniprot ID: Q96JY6
  ENSP ID: ENSP00000312634
MRGGRARPAWESFMGLPPRSSAKWGAGQSLDRLCCAPGSRGLAGAPGRMRAPPAGRSQPAGGPGDSLPHPPGGLGPGGSAWARRAEAAASRARGGGRGGPGITWAEAGPGAPGGLSPESGRRQRERWRLPAFPPSRAWAPSRTGERQPGERAHLRLSARPALPGAGLLSAPLSARNPGLVRGPAPWSLASAGAPPRAALSPAGALLLQPPARRVLCPRSEGGSRTGRAGPSGWAPPRGARSAESTDRLKGMALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIANQAVRIQEGRYRHPGCYTCADCGLNLKMRGHFWVGDELYCEKHARQRYSAPATLSSRA

SEQ ID NO: 61582 - protein, 602 aa, Homo sapiens; identical to SEQ ID NO: 61581
  Payload ID: 12298
  Gene Symbol: PDLIM2
  Gene Name: PDZ and LIM domain 2 (mystique)
  Uniprot ID: Q96JY6
  ENSP ID: ENSP00000342035

SEQ ID NO: 61583 - protein, 352 aa, Homo sapiens
  Payload ID: 12298
  Gene Symbol: PDLIM2
  Gene Name: PDZ and LIM domain 2 (mystique)
  Uniprot ID: Q96JY6
  ENSP ID: ENSP00000380867
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIANQAVRIQEGRYRHPGCYTCADCGLNLKMRGHFWVGDELYCEKHARQRYSAPATLSSRA

SEQ ID NO: 61584 - protein, 352 aa, Homo sapiens; identical to SEQ ID NO: 61583
  Payload ID: 12298
  Gene Symbol: PDLIM2
  Gene Name: PDZ and LIM domain 2 (mystique)
  Uniprot ID: Q96JY6
  ENSP ID: ENSP00000380868

SEQ ID NO: 61585 - protein, 278 aa, Homo sapiens
  Payload ID: 12298
  Gene Symbol: PDLIM2
  Gene Name: PDZ and LIM domain 2 (mystique)
  Uniprot ID: Q96JY6
  ENSP ID: ENSP00000386868
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGTRLCASRRAGTATPAATPVPTVG

SEQ ID NO: 61586 - protein, 352 aa, Homo sapiens; identical to SEQ ID NO: 61583
  Payload ID: 12298
  Gene Symbol: PDLIM2
  Gene Name: PDZ and LIM domain 2 (mystique)
  Uniprot ID: Q96JY6
  ENSP ID: ENSP00000387084

SEQ ID NO: 61587 - protein, 173 aa, Homo sapiens
  Payload ID: 12298
  Gene Symbol: PDLIM2
  Gene Name: PDZ and LIM domain 2 (mystique)
  ENSP ID: ENSP00000392920
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYS

SEQ ID NO: 61588 - protein, 254 aa, Homo sapiens
  Payload ID: 12298
  Gene Symbol: PDLIM2
  Gene Name: PDZ and LIM domain 2 (mystique)
  ENSP ID: ENSP00000394376
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEER

SEQ ID NO: 61589 - protein, 153 aa, Homo sapiens
  Payload ID: 12298
  Gene Symbol: PDLIM2
  Gene Name: PDZ and LIM domain 2 (mystique)
  ENSP ID: ENSP00000397738
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISR

SEQ ID NO: 61590 - protein, 235 aa, Homo sapiens
  Payload ID: 12298
  Gene Symbol: PDLIM2
  Gene Name: PDZ and LIM domain 2 (mystique)
  ENSP ID: ENSP00000401992
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAA

SEQ ID NO: 61591 - protein, 180 aa, Homo sapiens
  Payload ID: 12298
  Gene Symbol: PDLIM2
  Gene Name: PDZ and LIM domain 2 (mystique)
  ENSP ID: ENSP00000407643
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQ

SEQ ID NO: 61592 - protein, 38 aa, Homo sapiens
  Payload ID: 12298
  Gene Symbol: PDLIM2
  Gene Name: PDZ and LIM domain 2 (mystique)
  ENSP ID: ENSP00000412936
MALTVDVAGPAPWGFRITGGRDFHTPIMVTKAAIWGDY

SEQ ID NO: 61593 - protein, 146 aa, Homo sapiens
  Payload ID: 12298
  Gene Symbol: PDLIM2
  Gene Name: PDZ and LIM domain 2 (mystique)
  ENSP ID: ENSP00000477546
MDSEGGSLLLDEDSEVFKMLQENREGRAAPRQSSSFRLLQEALEAEERGGTPAFLPSSLSPQSSLPASRALATPPKLHTCEKCSTSIANQAVRIQEGRYRHPGCYTCADCGLNLKMRGHFWVGDELYCEKHARQRYSAPATLSSRA

SEQ ID NO: 61594 - protein, 18 aa, Homo sapiens
  Payload ID: 12298
  Gene Symbol: PDLIM2
  Gene Name: PDZ and LIM domain 2 (mystique)
  ENSP ID: ENSP00000478370
MALTVDVAGPAPWGFRIT

SEQ ID NO: 61595 - protein, 72 aa, Homo sapiens
  Payload ID: 12298
  Gene Symbol: PDLIM2
  Gene Name: PDZ and LIM domain 2 (mystique)
  ENSP ID: ENSP00000478826
MDSEGGSLLLDEDSEVFKMLQENREGRAAPRQSSSFRLLQEALEAEERGTRLCASRRAGTATPAATPVPTVG

SEQ ID NO: 61596 - protein, 325 aa, Homo sapiens [sequence omitted]

SEQ ID NO: 61597 - protein, 137 aa, Homo sapiens
  Payload ID: 12298
  Gene Symbol: PDLIM2
  Gene Name: PDZ and LIM domain 2 (mystique)
  ENSP ID: ENSP00000481074
GQTNGDSSLEVLATRFQGSVRTYTESQSSLRSSYSSPTSLSPRAGSPFSPPPSSSSLTGEAAISRSFQSLACSPGLPAADRLSYSGRPGSRQHGLGRGKPPPGRGLGSLQDAAGKSRGTGGPPTVQLLSALAGSPGG

SEQ ID NO: 61598 - protein, 146 aa, Homo sapiens; identical to SEQ ID NO: 61593
  Payload ID: 12298
  Gene Symbol: PDLIM2
  Gene Name: PDZ and LIM domain 2 (mystique)
  ENSP ID: ENSP00000481268

SEQ ID NO: 61599 - protein, 276 aa, Homo sapiens
  Payload ID: 12299
  Gene Symbol: PDLIM3
  Gene Name: PDZ and LIM domain 3
  ENSP ID: ENSP00000284767
MPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQDGNYFEHKHNIRPKPFVIPGRSSEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 61600 - protein, 364 aa, Homo sapiens
  Payload ID: 12299
  Gene Symbol: PDLIM3
  Gene Name: PDZ and LIM domain 3
  Uniprot ID: Q53GG5
  ENSP ID: ENSP00000284770
MPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQDGNYFEHKHNIRPKPFVIPGRSSGCSTPSGIDCGSGRSTPSSVSTVSTICPGDLKVAAKLAPNIPLEMELPGVKIVHAQFNTPMQLYSDDNIMETLQGQVSTALGETPLMSEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 61601 - protein, 316 aa, Homo sapiens
  Payload ID: 12299
  Gene Symbol: PDLIM3
  Gene Name: PDZ and LIM domain 3
  Uniprot ID: Q53GG5
  ENSP ID: ENSP00000284771
MPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQEFKPIGTAHNRRAQPFVAAANIDDKRQVVSASYNSPIGLYSTSNIQDALHGQLRGLIPSSPQNEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 61602 - protein, 42 aa, Homo sapiens
  Payload ID: 12299
  Gene Symbol: PDLIM3
  Gene Name: PDZ and LIM domain 3
  ENSP ID: ENSP00000421972
MPQTVILPGPAPWGFRLSGGIDFNQPLVITRGRNSLMVSTSI

SEQ ID NO: 61603 - protein, 42 aa, Homo sapiens; identical to SEQ ID NO: 61602
  Payload ID: 12299
  Gene Symbol: PDLIM3
  Gene Name: PDZ and LIM domain 3
  ENSP ID: ENSP00000425138

SEQ ID NO: 61604 - protein, 197 aa, Homo sapiens
  Payload ID: 12299
  Gene Symbol: PDLIM3
  Gene Name: PDZ and LIM domain 3
  ENSP ID: ENSP00000481771
MPQTVILPGPAPWGFRLSGGIDFNQPLVITRDGNYFEHKHNIRPKPFVIPGRSSEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 61605 - protein, 42 aa, Homo sapiens; identical to SEQ ID NO: 61602
  Payload ID: 12299
  Gene Symbol: PDLIM3
  Gene Name: PDZ and LIM domain 3
  ENSP ID: ENSP00000486107

SEQ ID NO: 61606 - protein, 330 aa, Homo sapiens
  Payload ID: 12300
  Gene Symbol: PDLIM4
  Gene Name: PDZ and LIM domain 4
  Uniprot ID: P50479
  ENSP ID: ENSP00000253754
MPHSVTLRGPSPWGFRLVGGRDFSAPLTISRVHAGSKAALAALCPGDLIQAINGESTELMTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSRDCRVDLGSEVYRMLREPAEPVAAEPKQSGSFRYLQGMLEAGEGGDWPGPGGPRNLKPTASKLGAPLSGLQGLPECTRCGHGIVGTIVKARDKLYHPECFMCSDCGLNLKQRGYFFLDERLYCESHAKARVKPPEGYDVVAVYPNAKVELV

SEQ ID NO: 61607 - protein, 246 aa, Homo sapiens
  Payload ID: 12300
  Gene Symbol: PDLIM4
  Gene Name: PDZ and LIM domain 4
  Uniprot ID: P50479
  ENSP ID: ENSP00000368303
MPHSVTLRGPSPWGFRLVGGRDFSAPLTISRVHAGSKAALAALCPGDLIQAINGESTELMTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSRDCRVDLGSEVYRMLREPAEPVAAEPKQSGSFRYLQGMLEAGEGGAPSSRHGTSSTIPSASCAVTAA

SEQ ID NO: 61608 - protein, 121 aa, Homo sapiens
  Payload ID: 12300
  Gene Symbol: PDLIM4
  Gene Name: PDZ and LIM domain 4
  ENSP ID: ENSP00000411753
MTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSR

SEQ ID NO: 61609 - protein, 596 aa, Homo sapiens
  Payload ID: 12301
  Gene Symbol: PDLIM5
  Gene Name: PDZ and LIM domain 5
  Uniprot ID: Q96HC4
  ENSP ID: ENSP00000321746
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTAAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVISALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 61610 - protein, 214 aa, Homo sapiens
  Payload ID: 12301
  Gene Symbol: PDLIM5
  Gene Name: PDZ and LIM domain 5
  Uniprot ID: Q96HC4
  ENSP ID: ENSP00000322021
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKKTQVTNNPGTVKIPPKRPPRKHIVERYTEFYHVPTHSDASKKRLIEDTEDWRPRTGTTQSRSFRILAQITGTEHLKESEADNTKKAKEKIPLHVFSPKYTKLRDWHHEVSARALNVQ

SEQ ID NO: 61611 - protein, 136 aa, Homo sapiens
  Payload ID: 12301
  Gene Symbol: PDLIM5
  Gene Name: PDZ and LIM domain 5
  Uniprot ID: Q96HC4
  ENSP ID: ENSP00000352210
MSNYSVSLVGPAPWGFRLQGGKDFNMPLTISSAGVQWRNLGSPQPPSPEFKRFSCLSLPSSWDYRHVPPRLANFVFLVETKFPYVGQAGLELPTSGDLPTSASQSAKITGVSHRAWPTLFYTLLFFATIYPEIILY

SEQ ID NO: 61612 - protein, 234 aa, Homo sapiens
  Payload ID: 12301
  Gene Symbol: PDLIM5
  Gene Name: PDZ and LIM domain 5
  Uniprot ID: Q96HC4
  ENSP ID: ENSP00000369527
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGKIPPKRPPRKHIVERYTEFYHVPTHSDASKKRLIEDTEDWRPRTGTTQSRSFRILAQITGTEHLKESEADNTKKAKEKIPLHVFSPKYTKLRDWHHEVSARALNVQ

SEQ ID NO: 61613 - protein, 271 aa, Homo sapiens
  Payload ID: 12301
  Gene Symbol: PDLIM5
  Gene Name: PDZ and LIM domain 5
  ENSP ID: ENSP00000398469
MPESLDSPTSGRPGVTSLTAAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVISALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 61614 - protein, 231 aa, Homo sapiens
  Payload ID: 12301
  Gene Symbol: PDLIM5
  Gene Name: PDZ and LIM domain 5
  ENSP ID: ENSP00000422528
  MOD_RES (1)..(1): Any amino acid
XASKKRLIEDTEDWRPRTGTTQSRSFRILAQITGTEHLKESEADNTKKANNSQEPSPQLASSVASTRSMPESLDSPTSGRPGVTSLTAAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILG

SEQ ID NO: 61615 - protein, 85 aa, Homo sapiens
  Payload ID: 12301
  Gene Symbol: PDLIM5
  Gene Name: PDZ and LIM domain 5
  ENSP ID: ENSP00000422833
LKDGGKAAQANVRIGDVVLSIDGINAQGMTHLEAQNKIKGCTGSLNMTLQRASAAPKPEPVPVQKPTKKTHCGALYRVLSCTHSQ

SEQ ID NO: 61616 - protein, 38 aa, Homo sapiens
  Payload ID: 12301
  Gene Symbol: PDLIM5
  Gene Name: PDZ and LIM domain 5
  ENSP ID: ENSP00000423009
MSNYSVSLVGPAPWGFRLQGGKDFNMPLTISSLTFWWR

SEQ ID NO: 61617 - protein, 483 aa, Homo sapiens
  Payload ID: 12301
  Gene Symbol: PDLIM5
  Gene Name: PDZ and LIM domain 5
  Uniprot ID: Q96HC4
  ENSP ID: ENSP00000424297
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGKIPPKRPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTAAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVISALKQTWHVSCFVCVACGKPIRNNVFHLEDGEPYCETDYYALFGTICHGCEFPIEAGDMFLEALGYTWHDTCFVCSVCCESLEGQTFFSKKDKPL

SEQ ID NO: 61618 - protein, 625 aa, Homo sapiens
  Payload ID: 12301
  Gene Symbol: PDLIM5
  Gene Name: PDZ and LIM domain 5
  Uniprot ID: Q96HC4
  ENSP ID: ENSP00000424360
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGKIPPKRPPRKHIVERYTEFYHVPTHSDASKKRLIEDTEDWRPRTGTTQSRSFRILAQITGTEHLKESEADNTKKAKFDSALEDLPKSGPHPPATPQVLTIGSQVATLSKVATTYSSLSSSTGNVEDSFEGFRNFSTFSSPARYSAAVLSSAAATVSAVIATKTRLYTPERYHSLLDALCISPVSKPLAFSYLQSSRKSTGSIHVKKTSNSQEPSPQLASSVASTRSMPESLDSPTSGRPGVTSLTAAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVISALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 61619 - protein, 47 aa, Homo sapiens
  Payload ID: 12301
  Gene Symbol: PDLIM5
  Gene Name: PDZ and LIM domain 5
  ENSP ID: ENSP00000426379
MSNYSVSLVGPAPWGFRLQGGKDFNMPLTISSVSKLYKFYYRCSFSA

SEQ ID NO: 61620 - protein, 234 aa, Homo sapiens; identical to SEQ ID NO: 61612
  Payload ID: 12301
  Gene Symbol: PDLIM5
  Gene Name: PDZ and LIM domain 5
  Uniprot ID: Q96HC4
  ENSP ID: ENSP00000426804

SEQ ID NO: 61621 - protein, 196 aa, Homo sapiens
  Payload ID: 12301
  Gene Symbol: PDLIM5
  Gene Name: PDZ and LIM domain 5
  ENSP ID: ENSP00000429577
  MOD_RES (1)..(1): Any amino acid
XKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKAKEKIPLHVFSPKYTKLRDWHHEVSARALNVQ

SEQ ID NO: 61622 - protein, 487 aa, Homo sapiens
  Payload ID: 12301
  Gene Symbol: PDLIM5
  Gene Name: PDZ and LIM domain 5
  Uniprot ID: Q96HC4
  ENSP ID: ENSP00000442187
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTAAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVISALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 61623 - protein, 625 aa, Homo sapiens; identical to SEQ ID NO: 61618
  Payload ID: 12301
  Gene Symbol: PDLIM5
  Gene Name: PDZ and LIM domain 5
  Uniprot ID: Q96HC4
  ENSP ID: ENSP00000480359

SEQ ID NO: 61624 - protein, 176 aa, Homo sapiens
  Payload ID: 12301
  Gene Symbol: PDLIM5
  Gene Name: PDZ and LIM domain 5
  ENSP ID: ENSP00000486834
MVIKLKDGGKAAQANVRIGDVVLSIDGINAQGMTHLEAQNKIKGCTGSLNMTLQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVP

SEQ ID NO: 61625 - protein, 39 aa, Homo sapiens
  Payload ID: 12301
  Gene Symbol: PDLIM5
  Gene Name: PDZ and LIM domain 5
  ENSP ID: ENSP00000486938
MSNYSVSLVGPAPWGFRLQGGKDFNMPLTISSSICCTQA

SEQ ID NO: 61626 - protein, 222 aa, Homo sapiens
  Payload ID: 12302
  Gene Symbol: PDLIM7
  Gene Name: PDZ and LIM domain 7 (enigma)
  Uniprot ID: Q9NR12
  ENSP ID: ENSP00000347776
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHLTGTEFMQDPDEEHLKKSREKYVLELQSPRYTRLRDWHHQRSAHVLNVQS

SEQ ID NO: 61627 - protein, 457 aa, Homo sapiens
  Payload ID: 12302
  Gene Symbol: PDLIM7
  Gene Name: PDZ and LIM domain 7 (enigma)
  Uniprot ID: Q9NR12
  ENSP ID: ENSP00000348099
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHLTGTEFMQDPDEEHLKKSSQVPRTEAPAPASSTPQEPWPGPTAPSPTSRPPWAVDPAFAERYAPDKTSTVLTRHSQPATPTPLQSRTSIVQAAAGGVPGGGSNNGKTPVCHQCHKVIRGRYLVALGHAYHPEEFVCSQCGKVLEEGGFFEEKGAIFCPPCYDVRYAPSCAKCKKKITGEIMHALKMTWHVHCFTCAACKTPIRNRAFYMEEGVPYCERDYEKMFGTKCHGCDFKIDAGDRFLEALGFSWHDTCFVCAICQINLEGKTFYSKKDRPLCKSHAFSHV

SEQ ID NO: 61628 - protein, 423 aa, Homo sapiens
  Payload ID: 12302
  Gene Symbol: PDLIM7
  Gene Name: PDZ and LIM domain 7 (enigma)
  Uniprot ID: Q9NR12
  ENSP ID: ENSP00000352964
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKVQTPDKQPLRPLVPDASKQRLMENTEDWRPRPGTGQSRSFRILAHLTGTEFMQDPDEEHLKKSSQVPRTEAPAPASSTPQEPWPGPTAPSPTSRPPWAVDPAFAERYAPDKTSTVLTRHSQPATPTPLQSRTSIVQAAAGGVPGGGSNNGKTPVCHQCHKVIRGRYLVALGHAYHPEEFVCSQCGKVLEEGGFFEEKGAIFCPPCYDVRYAPSCAKCKKKITGEIMHALKMTWHVHCFTCAACKTPIRNRAFYMEEGVPYCERDYEKMFGTKCHGCDFKIDAGDRFLEALGFSWHDTCFVCAICQINLEGKTFYSKKDRPLCKSHAFSHV

SEQ ID NO: 61629 - protein, 195 aa, Homo sapiens
  Payload ID: 12302
  Gene Symbol: PDLIM7
  Gene Name: PDZ and LIM domain 7 (enigma)
  ENSP ID: ENSP00000377177
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKAPTLPCPPALPGCVSAQASAPAADPPRYTFAPSVSLNKTARPFGAPPPADSAPQQNGQPLRPLVPDASKQRLMENTEDWRPRPGTGQSRSFRILAHLTGTEF

SEQ ID NO: 61630 - protein, 287 aa, Homo sapiens
  Payload ID: 12302
  Gene Symbol: PDLIM7
  Gene Name: PDZ and LIM domain 7 (enigma)
  Uniprot ID: Q9NR12
  ENSP ID: ENSP00000377182
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHLTGTEFMQDPDEEHLKKSRPYRPQPYQPPALGCGPCVCRALCPGQNEHSADPAQPAGHAHAAAEPHLHCAGSCRRGARRGQQQRQDSRVSPVPQGHPGPLPGGAGPRVPPGGVCV

SEQ ID NO: 61631 - protein, 90 aa, Homo sapiens
  Payload ID: 12302
  Gene Symbol: PDLIM7
  Gene Name: PDZ and LIM domain 7 (enigma)
  ENSP ID: ENSP00000421664
MDSFKVVLEGPAPWGFRLQGGKDFNVPLSISRLTPGGKAAQAGVAVGDWVLSIDGENAGSLTHIEAQNKIRACGERLSLGLSRAQPVQSK

SEQ ID NO: 61632 - protein, 120 aa, Homo sapiens
  Payload ID: 12302
  Gene Symbol: PDLIM7
  Gene Name: PDZ and LIM domain 7 (enigma)
  ENSP ID: ENSP00000422363
  MOD_RES (1)..(1): Any amino acid
XISRLTPGGKAAQAGVAVGDWVLSIDGENAGSLTHIEAQNKIRACGERLSLGLSRAQPVQSKPQKAPHFHPGPHLTLPARPARLCLCPGLRPRRGPSAVHLCTQRLPQQDGPALWGAPAR

SEQ ID NO: 61633 - protein, 173 aa, Homo sapiens
  Payload ID: 12302
  Gene Symbol: PDLIM7
  Gene Name: PDZ and LIM domain 7 (enigma)
  ENSP ID: ENSP00000424850
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHL

SEQ ID NO: 61634 - protein, 287 aa, Homo sapiens
  Payload ID: 12302
  Gene Symbol: PDLIM7
  Gene Name: PDZ and LIM domain 7 (enigma)
  ENSP ID: ENSP00000426213
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHLTGTEFMQDPDEEHLKKSRWLPGMRGTPGAASEAGALPRLPARDRTPANWTLLGEAALPIPTPVGPGIQLGSFHAPSHLPWGQQDPGWGVGPCQEAQPCRALNGRSCSQVPRTEA

SEQ ID NO: 61635 - protein, 153 aa, Homo sapiens
  Payload ID: 12302
  Gene Symbol: PDLIM7
  Gene Name: PDZ and LIM domain 7 (enigma)
  Uniprot ID: Q9NR12
  ENSP ID: ENSP00000431236
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGCRPLTNSRSDRWSQMPASSG

SEQ ID NO: 61636 - protein, 191 aa, Homo sapiens
  Payload ID: 12302
  Gene Symbol: PDLIM7
  Gene Name: PDZ and LIM domain 7 (enigma)
  Uniprot ID: Q9NR12
  ENSP ID: ENSP00000439157
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHLTGTEFMQDPDEEHLKKSS

SEQ ID NO: 61637 - protein, 322 aa, Homo sapiens
  Payload ID: 12303
  Gene Symbol: PBK
  Gene Name: PDZ binding kinase
  Uniprot ID: Q96KB5
  ENSP ID: ENSP00000301905
MEGISNFKTPSKLSEKKKSVLCSTPTINIPASPFMQKLGFGTGVNVYLMKRSPRGLSHSPWAVKKINPICNDHYRSVYQKRLMDEAKILKSLHHPNIVGYRAFTEANDGSLCLAMEYGGEKSLNDLIEERYKASQDPFPAAIILKVALNMARGLKYLHQEKKLLHGDIKSSNVVIKGDFETIKICDVGVSLPLDENMTVTDPEACYIGTEPWKPKEAVEENGVITDKADIFAFGLTLWEMMTLSIPHINLSNDDDDEDKTFDESDFDDEAYYAALGTRPPINMEELDESYQKVIELFSVCTNEDPKDRPSAAHIVEALETDV

SEQ ID NO: 61638 - protein, 151 aa, Homo sapiens
  Payload ID: 12303
  Gene Symbol: PBK
  Gene Name: PDZ binding kinase
  ENSP ID: ENSP00000427892
MQKLGFGTGVNVYLMKRSPRGLSHSPWAVKKINPICNDHYRSVYQKRLMDEAKILKSLHHPNIVGYRAFTEANDGSLCLAMEYGGEKSLNDLIEERYKASQDPFPAAIILKVALNMARGLKYLHQEKKLLHGDIKSSNVVIKGDFETIKIC

SEQ ID NO: 61639 - protein, 63 aa, Homo sapiens
  Payload ID: 12303
  Gene Symbol: PBK
  Gene Name: PDZ binding kinase
  ENSP ID: ENSP00000428438
MEGISNFKTPSKLSEKKKSVLCSTPTINIPASPFMQKLGFGTGVNVYLMKSICTKKRNCFMET

SEQ ID NO: 61640 - protein, 333 aa, Homo sapiens
  Payload ID: 12303
  Gene Symbol: PBK
  Gene Name: PDZ binding kinase
  Uniprot ID: Q96KB5
  ENSP ID: ENSP00000428489
MEGISNFKTPSKLSEKKKSVLCSTPTINIPASPFMQKLGFGTGVNVYLMKRSPRGLSHSPWAVKKINPICNDHYRSVYQKRLMDEAKILKSLHHPNIVGYRAFTEANDGSLCLAMEYGGEKSLNDLIEERYKASQDPFPAAIILKVALNMARGLKYLHQEKKLLHGDIKSSNVVIKGDFETIKICDVGVSLPLDENMTAPAFITILLVSVTDPEACYIGTEPWKPKEAVEENGVITDKADIFAFGLTLWEMMTLSIPHINLSNDDDDEDKTFDESDFDDEAYYAALGTRPPINMEELDESYQKVIELFSVCTNEDPKDRPSAAHIVEALETDV

SEQ ID NO: 61641 - protein, 519 aa, Homo sapiens
  Payload ID: 12304
  Gene Symbol: PDZK1
  Gene Name: PDZ domain containing 1
  Uniprot ID: Q5T2W1
  ENSP ID: ENSP00000342143
MTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAHSTASHSSSNSEDTEM

SEQ ID NO: 61642 - protein, 519 aa, Homo sapiens; identical to SEQ ID NO: 61641
  Payload ID: 12304
  Gene Symbol: PDZK1
  Gene Name: PDZ domain containing 1
  Uniprot ID: Q5T2W1
  ENSP ID: ENSP00000394485

SEQ ID NO: 61643 - protein, 408 aa, Homo sapiens
  Payload ID: 12304
  Gene Symbol: PDZK1
  Gene Name: PDZ domain containing 1
  Uniprot ID: Q5T2W1
  ENSP ID: ENSP00000403422
MTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAHSTASHSSSNSEDTEM

SEQ ID NO: 61644 - protein, 264 aa, Homo sapiens
  Payload ID: 12304
  Gene Symbol: PDZK1
  Gene Name: PDZ domain containing 1
  ENSP ID: ENSP00000409291
MTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQK

SEQ ID NO: 61645 - protein, 140 aa, Homo sapiens
  Payload ID: 12305
  Gene Symbol: PDZD11
  Gene Name: PDZ domain containing 11
  Uniprot ID: Q5EBL8
  ENSP ID: ENSP00000239666
MDSRIPYDDYPVVFLPAYENPPAWIPPHERVHHPDYNNELTQFLPRTITLKKPPGAQLGFNIRGGKASQLGIFISKVIPDSDAHRAGLQEGDQVLAVNDVDFQDIEHSKAVEILKTAREISMRVRFFPYNYHRQKERTVH

SEQ ID NO: 61646 - protein, 140 aa, Homo sapiens; identical to SEQ ID NO: 61645
  Payload ID: 12305
  Gene Symbol: PDZD11
  Gene Name: PDZ domain containing 11
  Uniprot ID: Q5EBL8
  ENSP ID: ENSP00000363578

SEQ ID NO: 61647 - protein, 2839 aa, Homo sapiens
  Payload ID: 12306
  Gene Symbol: PDZD2
  Gene Name: PDZ domain containing 2
  Uniprot ID: O15018
  ENSP ID: ENSP00000402033
MPITQDNAVLHLPLLYQWLQNSLQEGGDGPEQRLCQAAIQKLQEYIQLNFAVDESTVPPDHSPPEMEICTVYLTKELGDTETVGLSFGNIPVFGDYGEKRRGGKKRKTHQGPVLDVGCIWVTELRKNSPAGKSGKVRLRDEILSLNGQLMVGVDVSGASYLAEQCWNGGFIYLIMLRRFKHKAHSTYNGNSSNSSEPGETPTLELGDRTAKKGKRTRKFGVISRPPANKAPEESKGSAGCEVSSDPSTELENGPDPELGNGHVFQLENGPDSLKEVAGPHLERSEVDRGTEHRIPKTDAPLTTSNDKRRFSKGGKTDFQSSDCLAREEVGRIWKMELLKESDGLGIQVSGGRGSKRSPHAIVVTQVKEGGAAHRDGRLSLGDELLVINGHLLVGLSHEEAVAILRSATGMVQLVVASKENSAEDLLRLTSKSLPDLTSSVEDVSSWTDNEDQEADGEEDEGTSSSVQRAMPGTDEPQDVCGAEESKGNLESPKQGSNKIKLKSRLSGGVHRLESVEEYNELMVRNGDPRIRMLEVSRDGRKHSLPQLLDSSSASQEYHIVKKSTRSLSTTQVESPWRLIRPSVISIIGLYKEKGKGLGFSIAGGRDCIRGQMGIFVKTIFPNGSAAEDGRLKEGDEILDVNGIPIKGLTFQEAIHTFKQIRSGLFVLTVRTKLVSPSLTPCSTPTHMSRSASPNFNTSGGASAGGSDEGSSSSLGRKTPGPKDRIVMEVTLNKEPRVGLGIGACCLALENSPPGIYIHSLAPGSVAKMESNLSRGDQILEVNSVNVRHAALSKVHAILSKCPPGPVRLVIGRHPNPKVSEQEMDEVIARSTYQESKEANSSPGLGTPLKSPSLAKKDSLISESELSQYFAHDVPGPLSDFMVAGSEDEDHPGSGCSTSEEGSLPPSTSTHKEPGKPRANSLVTLGSHRASGLFHKQVTVARQASLPGSPQALRNPLLRQRKVGCYDANDASDEEEFDREGDCISLPGALPGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARVSPHCKRSEAEAKPSGSQTVNLTGRANDPCDLDSRVQATSVKVTVAGFQPGGAVEKESLGKLTTGDACVSTSCELASALSHLDASHLTENLPKAASELGQQPMTELDSSSDLISSPGKKGAAHPDPSKTSVDTGQVSRPENPSQPASPRVTKCKARSPVRLPHEGSPSPGEKAAAPPDYSKTRSASETSTPHNTRRVAALRGAGPGAEGMTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSSQKKGVTVPHSPPQPKTNLENKDLSKKSPAEMLLTNGQKAKCGPKLKRLSLKGKAKVNSEAPAANAVKAGGTDHRKPLISPQTSHKTLSKAVSQRLHVADHEDPDRNTTAAPRSPQCVLESKPPLATSGPLKPSVSDTSIRTFVSPLTSPKPVPEQGMWSRFHMAVLSEPDRGCPTTPKSPKCRAEGRAPRADSGPVSPAASRNGMSVAGNRQSEPRLASHVAADTAQPRPTGEKGGNIMASDRLERTNQLKIVEISAEAVSETVCGNKPAESDRRGGCLAQGNCQEKSEIRLYRQVAESSTSHPSSLPSHASQAEQEMSRSFSMAKLASSSSSLQTAIRKAEYSQGKSSLMSDSRGVPRNSIPGGPSGEDHLYFTPRPATRTYSMPAQFSSHFGREGHPPHSLGRSRDSQVPVTSSVVPEAKASRGGLPSLANGQGIYSVKPLLDTSRNLPATDEGDIISVQETSCLVTDKIKVTRRHYCYEQNWPHESTSFFSVKQRIKSFENLANADRPVAKSGASPFLSVSSKPPIGRRSSGSIVSGSLGHPGDAAARLLRRSLSSCSENQSEAGTLLPQMAKSPSIMTLTISRQNPPETSSKGSDSELKKSLGPLGIPTPTMTLASPVKRNKSSVRHTQPSPVSRSKLQELRALSMPDLDKLCSEDYSAGPSAVLFKTELEITPRRSPGPPAGGVSCPEKGGNRACPGGSGPKTSAAETPSSASDTGEAAQDLPFRRSWSVNLDQLLVSAGDQQRLQSVLSSVGSKSTILTLIQEAKAQSENEEDVCFIVLNRKEGSGLGFSVAGGTDVEPKSITVHRVFSQGAASQEGTMNRGDFLLSVNGASLAGLAHGNVLKVLHQAQLHKDALVVIKKGMDQPRPSARQEPPTANGKGLLSRKTIPLEPGIGRSVAVHDALCVEVLKTSAGLGLSLDGGKSSVTGDGPLVIKRVYKGGAAEQAGIIEAGDEILAINGKPLVGLMHFDAWNIMKSVPEGPVQLLIRKHRNSS

SEQ ID NO: 61648 - protein, 13 aa, Homo sapiens
  Payload ID: 12306
  Gene Symbol: PDZD2
  Gene Name: PDZ domain containing 2
  ENSP ID: ENSP00000424901
MPITQDNAVLHLP

SEQ ID NO: 61649 - protein, 491 aa, Homo sapiens
  Payload ID: 12307
  Gene Symbol: PDZD3
  Gene Name: PDZ domain containing 3
  Uniprot ID: Q86UT5
  ENSP ID: ENSP00000327107
MEKAADLQDTASLTLKFKFNPKLGIDNPVLSLAEDHDPYDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPRGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 61650 - protein, 505 aa, Homo sapiens
  Payload ID: 12307
  Gene Symbol: PDZD3
  Gene Name: PDZ domain containing 3
  Uniprot ID: Q86UT5
  ENSP ID: ENSP00000347742
MEKAADLQDTASLTLKFKFNPKLGIDNPVLSLAEDHDPYDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGVSVEKFTHNQLTRKLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPRGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 61651 - protein, 571 aa, Homo sapiens
  Payload ID: 12307
  Gene Symbol: PDZD3
  Gene Name: PDZ domain containing 3
  Uniprot ID: Q86UT5
  ENSP ID: ENSP00000431164
MVTPSPPGNHSLSLEAPRLHTASDLLGNHSLGLPLITALVGSRDRRGRVFSPVPVPLPTNPTTQHPTRQKLPSTLSGHRVCQAHGEPVLGLCPLLPLFCCPPHPPDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGVSVEKFTHNQLTRKLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPRGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 61652 - protein, 119 aa, Homo sapiens
  Payload ID: 12307
  Gene Symbol: PDZD3
  Gene Name: PDZ domain containing 3
  ENSP ID: ENSP00000434264
MEKAADLQDTASLTLKFKFNPKLGIDNPVLSLAEDHDPYDPWSLERPRFCLLSKEEGKSFGFHLQQELGRAGHVVCRVDPGTSAQRQGLQEGDRILAVNNDVVEHEDYAVAIRVLSGWC

SEQ ID NO: 61653 - protein, 492 aa, Homo sapiens
  Payload ID: 12307
  Gene Symbol: PDZD3
  Gene Name: PDZ domain containing 3
  ENSP ID: ENSP00000434559
MVTPSPPGNHSLSLEAPRLHTASDLLDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGVSVEKFTHNQLTRKLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPRGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 61654 - protein, 769 aa, Homo sapiens
  Payload ID: 12308
  Gene Symbol: PDZD4
  Gene Name: PDZ domain containing 4
  Uniprot ID: Q76G19
  ENSP ID: ENSP00000164640
MGCNMCVVQKPEEQYKVMLQVNGKELSKLSQEQTLQALRSSKEPLVIQVLRRSPRLRGDSSCHDLQLVDSGTQTDITFEHIMALGKLRPPTPPMVILEPPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQPGNEEEKGAPDAGPGLSNSQELDSGVGRTDESTRNEESSEHDLLGDEPPSSTNTPGSLRKFGLQGDALQSRDFHFSMDSLLAEGAGLGGGDVPGLTDEEYERYRELLEIKCHLENGNQLGLLFPRASGGNSALDVNRNESLGHEMAMLEEELRHLEFKCRNILRAQKMQQLRERCMKAWLLEEESLYDLAASEPKKHELSDISELPEKSDKDSTSAYNTGESCRSTPLLVEPLPESPLRRAMAGNSNLNRTPPGPAVATPAKAAPPPGSPAKFRSLSRDPEAGRRQHAEERGRRNPKTGLTLERVGPESSPYLSRRHRGQGQEGEHYHSCVQLAPTRGLEELGHGPLSLAGGPRVGGVAAAATEAPRMEWKVKVRSDGTRYVAKRPVRDRLLKARALKIREERSGMTTDDDAVSEMKMGRYWSKEERKQHLIRAREQRKRREFMMQSRLECLREQQNGDSKPELNIIALSHRKTMKKRNKKILDNWITIQEMLAHGARSADGKRVYNPLLSVTTV

SEQ ID NO: 61655 - protein, 775 aa, Homo sapiens
  Payload ID: 12308
  Gene Symbol: PDZD4
  Gene Name: PDZ domain containing 4
  ENSP ID: ENSP00000377355
MGCNMCVVQKPEEQYKVMLQVNGKELSKLSQEQTLQALRSSKEPLVIQVLRRSPRLRGDSSCHDLQLVDSGTQTDITFEHIMALGKLRPPTPPMVILEPYVLSELPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQPGNEEEKGAPDAGPGLSNSQELDSGVGRTDESTRNEESSEHDLLGDEPPSSTNTPGSLRKFGLQGDALQSRDFHFSMDSLLAEGAGLGGGDVPGLTDEEYERYRELLEIKCHLENGNQLGLLFPRASGGNSALDVNRNESLGHEMAMLEEELRHLEFKCRNILRAQKMQQLRERCMKAWLLEEESLYDLAASEPKKHELSDISELPEKSDKDSTSAYNTGESCRSTPLLVEPLPESPLRRAMAGNSNLNRTPPGPAVATPAKAAPPPGSPAKFRSLSRDPEAGRRQHAEERGRRNPKTGLTLERVGPESSPYLSRRHRGQGQEGEHYHSCVQLAPTRGLEELGHGPLSLAGGPRVGGVAAAATEAPRMEWKVKVRSDGTRYVAKRPVRDRLLKARALKIREERSGMTTDDDAVSEMKMGRYWSKEERKQHLIRAREQRKRREFMMQSRLECLREQQNGDSKPELNIIALSHRKTMKKRNKKILDNWITIQEMLAHGARSADGKRVYNPLLSVTTV

SEQ ID NO: 61656 - protein, 660 aa, Homo sapiens
  Payload ID: 12308
  Gene Symbol: PDZD4
  Gene Name: PDZ domain containing 4
  Uniprot ID: Q76G19
  ENSP ID: ENSP00000442033
MGCNMCVVQKPEEQYKVMLQEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQPGNEEEKGAPDAGPGLSNSQELDSGVGRTDESTRNEESSEHDLLGDEPPSSTNTPGSLRKFGLQGDALQSRDFHFSMDSLLAEGAGLGGGDVPGLTDEEYERYRELLEIKCHLENGNQLGLLFPRASGGNSALDVNRNESLGHEMAMLEEELRHLEFKCRNILRAQKMQQLRERCMKAWLLEEESLYDLAASEPKKHELSDISELPEKSDKDSTSAYNTGESCRSTPLLVEPLPESPLRRAMAGNSNLNRTPPGPAVATPAKAAPPPGSPAKFRSLSRDPEAGRRQHAEERGRRNPKTGLTLERVGPESSPYLSRRHRGQGQEGEHYHSCVQLAPTRGLEELGHGPLSLAGGPRVGGVAAAATEAPRMEWKVKVRSDGTRYVAKRPVRDRLLKARALKIREERSGMTTDDDAVSEMKMGRYWSKEERKQHLIRAREQRKRREFMMQSRLECLREQQNGDSKPELNIIALSHRKTMKKRNKKILDNWITIQEMLAHGARSADGKRVYNPLLSVTTV

SEQ ID NO: 61657 - protein, 122 aa, Homo sapiens
  Payload ID: 12308
  Gene Symbol: PDZD4
  Gene Name: PDZ domain containing 4
  ENSP ID: ENSP00000476940
MGCNMCVVQKPEEQYKVMLQVNGKELSKLSQEQTLQALRSSKEPLVIQVLRRSPRLRGDSSCHDLQLVDSGTQTDITFEHIMALGKLRPPTPPMVILEPYVLSELAEGGPSCPGRRCRKCQG

SEQ ID NO: 61658 - protein, 517 aa, Homo sapiens
  Payload ID: 12309
  Gene Symbol: PDZD7
  Gene Name: PDZ domain containing 7
  Uniprot ID: Q9H5P4
  ENSP ID: ENSP00000359234
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAERAGLCVGDKITEVNGLSLESTTMGSAVKVLTSSSRLHMMVRRMGRVPGIKFSKEKTTWVDVVNRRLVVEKCGSTPSDTSSEDGVRRIVHLYTTSDDFCLGFNIRGGKEFGLGIYVSKVDHGGLAEENGIKVGDQVLAANGVRFDDISHSQAVEVLKGQTHIMLTIKETGRYPAYKEMVSEYCWLDRLSNGVLQQLSPASESSSSVSSCASSAPYSSGSLPSDRMDICLGQEEPGSRGPGWGRADTAMQTEPDAGGRVETWCSVRPTVILRDTAIRSDGPHPGRRLDSALSESPKTALLLALSRPRPPITRSQSYLTLWEEKQQRKKEKSGSPGEKGALQRSKTLMNLFFKGGRQGRLARDGRREAWTLDSGSLAKTYPRLDIEKEMGVSPCCPG

SEQ ID NO: 61659 - protein, 208 aa, Homo sapiens
  Payload ID: 12309
  Gene Symbol: PDZD7
  Gene Name: PDZ domain containing 7
  ENSP ID: ENSP00000412533
  MOD_RES (1)..(1): Any amino acid
XPRPPITRSQSYLTLWEEKQQRKKEKSGSPGEKGALQRSKTLMNLFFKGGRQGRLARDGRREAWTLDSGSLAKTYPRLDIEKAGGVGPVQKFVTWRLRRDQERGRALLSARSGSPSSQLPNVDEQVQAWESRRPLIQDLAQRLLTDDEVLAVTRHCSRYVHEGGIEDLVRPLLAILDRPEKLLLLQDIRSVVAPTDLGRFDSMVMLVE

SEQ ID NO: 61660 - protein, 133 aa, Homo sapiens
  Payload ID: 12309
  Gene Symbol: PDZD7
  Gene Name: PDZ domain containing 7
  ENSP ID: ENSP00000474447
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAGKQNPQAEVHA

SEQ ID NO: 61661 - protein, 181 aa, Homo sapiens
  Payload ID: 12309
  Gene Symbol: PDZD7
  Gene Name: PDZ domain containing 7
  ENSP ID: ENSP00000474831
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAERAGLCVGDKITEVNGLSLESTTMGSAVKVLTSSSRLHMMVRRMGRVPGIKFSKEKTTW

SEQ ID NO: 61662 - protein, 1033 aa, Homo sapiens
  Payload ID: 12309
  Gene Symbol: PDZD7
  Gene Name: PDZ domain containing 7
  Uniprot ID: Q9H5P4
  ENSP ID: ENSP00000480489
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAERAGLCVGDKITEVNGLSLESTTMGSAVKVLTSSSRLHMMVRRMGRVPGIKFSKEKTTWVDVVNRRLVVEKCGSTPSDTSSEDGVRRIVHLYTTSDDFCLGFNIRGGKEFGLGIYVSKVDHGGLAEENGIKVGDQVLAANGVRFDDISHSQAVEVLKGQTHIMLTIKETGRYPAYKEMVSEYCWLDRLSNGVLQQLSPASESSSSVSSCASSAPYSSGSLPSDRMDICLGQEEPGSRGPGWGRADTAMQTEPDAGGRVETWCSVRPTVILRDTAIRSDGPHPGRRLDSALSESPKTALLLALSRPRPPITRSQSYLTLWEEKQQRKKEKSGSPGEKGALQRSKTLMNLFFKGGRQGRLARDGRREAWTLDSGSLAKTYPRLDIEKAGGVGPVQKFVTWRLRRDQERGRALLSARSGSPSSQLPNVDEQVQAWESRRPLIQDLAQRLLTDDEVLAVTRHCSRYVHEGGIEDLVRPLLAILDRPEKLLLLQDIRSVVAPTDLGRFDSMVMLVELEAFEALKSRAVRPPALRPARQDTPPKRHLITPVPDSRGGFYLLPVNGFPEEEDNGELRERLGALKVSPSASAPRHPHKGIPPLQDVPVDAFTPLRIACTPPPQLPPVAPRPLRPNWLLTEPLSREHPPQSQIRGRAQSRSRSRSRSRSRSSRGQGKSPGRRSPSPVPTPAPSMTNGRYHKPRKARPPLPRPLDGEAAKVGAKQGPSESGTEGTAKEAAMKNPSGELKTVTLSKMKQSLGISISGGIESKVQPMVKIEKIFPGGAAFLSGALQAGFELVAVDGENLEQVTHQRAVDTIRRAYRNKAREPMELVVRVPGPSPRPSPSDSSALTDGGLPADHLPAHQPLDAAPVPAHWLPEPPTNPQTPPTDARLLQPTPSPAPSPALQTPDSKPAPSPRIP

SEQ ID NO: 61663 - protein, 1154 aa, Homo sapiens
  Payload ID: 12310
  Gene Symbol: PDZD8
  Gene Name: PDZ domain containing 8
  Uniprot ID: Q8NEN9
  ENSP ID: ENSP00000334642
MGLLLMILASAVLGSFLTLLAQFFLLYRRQPEPPADEAARAGEGFRYIKPVPGLLLREYLYGGGRDEEPSGAAPEGGATPTAAPETPAPPTRETCYFLNATILFLFRELRDTALTRRWVTKKIKVEFEELLQTKTAGRLLEGLSLRDVFLGETVPFIKTIRLVRPVVPSATGEPDGPEGEALPAACPEELAFEAEVEYNGGFHLAIDVDLVFGKSAYLFVKLSRVVGRLRLVFTRVPFTHWFFSFVEDPLIDFEVRSQFEGRPMPQLTSIIVNQLKKIIKRKHTLPNYKIRFKPFFPYQTLQGFEEDEEHIHIQQWALTEGRLKVTLLECSRLLIFGSYDREANVHCTLELSSSVWEEKQRSSIKTVELIKGNLQSVGLTLRLVQSTDGYAGHVIIETVAPNSPAAIADLQRGDRLIAIGGVKITSTLQVLKLIKQAGDRVLVYYERPVGQSNQGAVLQDNFGQLEENFLSSSCQSGYEEEAAGLTVDTESRELDSEFEDLASDVRAQNEFKDEAQSLSHSPKRVPTTLSIKPLGAISPVLNRKLAVGSHPLPPKIQSKDGNKPPPLKTSEITDPAQVSKPTQGSAFKPPVPPRPQAKVPLPSADAPNQAEPDVLVEKPEKVVPPPLVDKSAEKQAKNVDAIDDAAAPKQFLAKQEVAKDVTSETSCPTKDSSDDRQTWESSEILYRNKLGKWTRTRASCLFDIEACHRYLNIALWCRDPFKLGGLICLGHVSLKLEDVALGCLATSNTEYLSKLRLEAPSPKAIVTRTALRNLSMQKGFNDKFCYGDITIHFKYLKEGESDHHVVTNVEKEKEPHLVEEVSVLPKEEQFVGQMGLTENKHSFQDTQFQNPTWCDYCKKKVWTKAASQCMFCAYVCHKKCQEKCLAETSVCGATDRRIDRTLKNLRLEGQETLLGLPPRVDAEASKSVNKTTGLTRHIINTSSRLLNLRQVSKTRLSEPGTDLVEPSPKHTPNTSDNEGSDTEVCGPNSPSKRGNSTGIKLVRKEGGLDDSVFIAVKEIGRDLYRGLPTEERIQKLEFMLDKLQNEIDQELEHNNSLVREEKETTDTRKKSLLSAALAKSGERLQALTLLMIHYRAGIEDIETLESLSLDQHSKKISKYTDDTEEDLDNEISQLIDSQPFSSISDDLFGPSESV

SEQ ID NO: 61664 - protein, 264 aa, Homo sapiens
  Payload ID: 12311
  Gene Symbol: PDZD9
  Gene Name: PDZ domain containing 9
  Uniprot ID: Q8IXQ8
  ENSP ID: ENSP00000400514
MQKASHKNKKERGVSNKVKTSVHNLSKTQQTKLTVGSLGLGLIIIQHGPYLQITHLIRKGAAANDGKLQPGDVLISVGHANVLGYTLREFLQLLQHITIGTVLQIKVYRDFINIPEEWQEIYDLIPEAKFPVTSTPKKIELAKDESFTSSDDNENVDLDKRLQYYRYPWSTVHHPARRPISISRDWHGYKKKNHTISVGKDINCDVMIHRDDKKEVRAPSPYWIMVKQDNESSSSSTSSTSDAFWLEDCAQVEEGKAQLVSKVG

SEQ ID NO: 61665 - protein, 97 aa, Homo sapiens
  Payload ID: 12311
  Gene Symbol: PDZD9
  Gene Name: PDZ domain containing 9
  ENSP ID: ENSP00000429211
MQKASHKNKKERGVSNKVKTSVHNLSKTQQTKLTVGSLGLGLIIIQHGPYLQITHLIRKGAAANDGKLQPGCTGSMAGEASGNLQSWQKVKRKEVMF

SEQ ID NO: 61666 - protein, 204 aa, Homo sapiens
  Payload ID: 12311
  Gene Symbol: PDZD9
  Gene Name: PDZ domain containing 9
  Uniprot ID: Q8IXQ8
  ENSP ID: ENSP00000441685
MQKASHKNKKGDVLISVGHANVLGYTLREFLQLLQHITIGTVLQIKVYRDFINIPEEWQEIYDLIPEAKFPVTSTPKKIELAKDESFTSSDDNENVDLDKRLQYYRYPWSTVHHPARRPISISRDWHGYKKKNHTISVGKDINCDVMIHRDDKKEVRAPSPYWIMVKQDNESSSSSTSSTSDAFWLEDCAQVEEGKAQLVSKVG

SEQ ID NO: 61667 - protein, 1066 aa, Homo sapiens
  Payload ID: 12312
  Gene Symbol: PDZRN3
  Gene Name: PDZ domain containing ring finger 3
  Uniprot ID: Q9UPQ7
  ENSP ID: ENSP00000263666
MGFELDRFDGDVDPDLKCALCHKVLEDPLTTPCGHVFCAGCVLPWVVQEGSCPARCRGRLSAKELNHVLPLKRLILKLDIKCAYATRGCGRVVKLQQLPEHLERCDFAPARCRHAGCGQVLLRRDVEAHMRDACDARPVGRCQEGCGLPLTHGEQRAGGHCCARALRAHNGALQARLGALHKALKKEALRAGKREKSLVAQLAAAQLELQMTALRYQKKFTEYSARLDSLSRCVAAPPGGKGEETKSLTLVLHRDSGSLGFNIIGGRPSVDNHDGSSSEGIFVSKIVDSGPAAKEGGLQIHDRIIEVNGRDLSRATHDQAVEAFKTAKEPIVVQVLRRTPRTKMFTPPSESQLVDTGTQTDITFEHIMALTKMSSPSPPVLDPYLLPEEHPSAHEYYDPNDYIGDIHQEMDREELELEEVDLYRMNSQDKLGLTVCYRTDDEDDIGIYISEIDPNSIAAKDGRIREGDRIIQINGIEVQNREEAVALLTSEENKNFSLLIARPELQLDEGWMDDDRNDFLDDLHMDMLEEQHHQAMQFTASVLQQKKHDEDGGTTDTATILSNQHEKDSGVGRTDESTRNDESSEQENNGDDATASSNPLAGQRKLTCSQDTLGSGDLPFSNESFISADCTDADYLGIPVDECERFRELLELKCQVKSATPYGLYYPSGPLDAGKSDPESVDKELELLNEELRSIELECLSIVRAHKMQQLKEQYRESWMLHNSGFRNYNTSIDVRRHELSDITELPEKSDKDSSSAYNTGESCRSTPLTLEISPDNSLRRAAEGISCPSSEGAVGTTEAYGPASKNLLSITEDPEVGTPTYSPSLKELDPNQPLESKERRASDGSRSPTPSQKLGSAYLPSYHHSPYKHAHIPAHAQHYQSYMQLIQQKSAVEYAQSQMSLVSMCKDLSSPTPSEPRMEWKVKIRSDGTRYITKRPVRDRLLRERALKIREERSGMTTDDDAVSEMKMGRYWSKEERKQHLVKAKEQRRRREFMMQSRLDCLKEQQAADDRKEMNILELSHKKMMKKRNKKIFDNWMTIQELLTHGTKSPDGTRVYNSFLSVTTV

SEQ ID NO: 61668 - protein, 360 aa, Homo sapiens
  Payload ID: 12312
  Gene Symbol: PDZRN3
  Gene Name: PDZ domain containing ring finger 3
  Uniprot ID: Q9UPQ7
  ENSP ID: ENSP00000308831
MGFELDRFDGDVDPDLKCALCHKVLEDPLTTPCGHVFCAGCVLPWVVQEGSCPARCRGRLSAKELNHVLPLKRLILKLDIKCAYATRGCGRVVKLQQLPEHLERCDFAPARCRHAGCGQVLLRRDVEAHMRDACDARPVGRCQEGCGLPLTHGEQRAGGHCCARALRAHNGALQARLGALHKALKKEALRAGKREKSLVAQLAAAQLELQMTALRYQKKFTEYSARLDSLSRCVAAPPGGKGEETKSLTLVLHRDSGSLGFNIIGGRPSVDNHDGSSSEGIFVSKIVDSGPAAKEGGLQIHDRIIEMRKLELRTVKLPKAHSQDSNAGFIPQLLSLHTPPLSCEKGGGHLACGGAYLNCI

SEQ ID NO: 61669 - protein, 723 aa, Homo sapiens
  Payload ID: 12312
  Gene Symbol: PDZRN3
  Gene Name: PDZ domain containing ring finger 3
  ENSP ID: ENSP00000418168
MFTPPSESQLVDTGTQTDITFEHIMALTKMSSPSPPVLDPYLLPEEHPSAHEYYDPNDYIGDIHQEMDREELELEEVDLYRMNSQDKLGLTVCYRTDDEDDIGIYISEIDPNSIAAKDGRIREGDRIIQINGIEVQNREEAVALLTSEENKNFSLLIARPELQLDEGWMDDDRNDFLDDLHMDMLEEQHHQAMQFTASVLQQKKHDEDGGTTDTATILSNQHEKDSGVGRTDESTRNDESSEQENNGDDATASSNPLAGQRKLTCSQDTLGSGDLPFSNESFISADCTDADYLGIPVDECERFRELLELKCQVKSATPYGLYYPSGPLDAGKSDPESVDKELELLNEELRSIELECLSIVRAHKMQQLKEQYRESWMLHNSGFRNYNTSIDVRRHELSDITELPEKSDKDSSSAYNTGESCRSTPLTLEISPDNSLRRAAEGISCPSSEGAVGTTEAYGPASKNLLSITEDPEVGTPTYSPSLKELDPNQPLESKERRASDGSRSPTPSQKLGSAYLPSYHHSPYKHAHIPAHAQHYQSYMQLIQQKSAVEYAQSQMSLVSMCKDLSSPTPSEPRMEWKVKIRSDGTRYITKRPVRDRLLRERALKIREERSGMTTDDDAVSEMKMGRYWSKEERKQHLVKAKEQRRRREFMMQSRLDCLKEQQAADDRKEMNILELSHKKMMKKRNKKIFDNWMTIQELLTHGTKSPDGTRVYNSFLSVTTV

SEQ ID NO: 61670 - protein, 723 aa, Homo sapiens; identical to SEQ ID NO: 61669
  Payload ID: 12312
  Gene Symbol: PDZRN3
  Gene Name: PDZ domain containing ring finger 3
  ENSP ID: ENSP00000418484

SEQ ID NO: 61671 - protein, 783 aa, Homo sapiens
  Payload ID: 12312
  Gene Symbol: PDZRN3
  Gene Name: PDZ domain containing ring finger 3
  ENSP ID: ENSP00000418624
MGCSLCSLQKQEEQYKLLYEVCQVNGRDLSRATHDQAVEAFKTAKEPIVVQVLRRTPRTKMFTPPSESQLVDTGTQTDITFEHIMALTKMSSPSPPVLDPYLLPEEHPSAHEYYDPNDYIGDIHQEMDREELELEEVDLYRMNSQDKLGLTVCYRTDDEDDIGIYISEIDPNSIAAKDGRIREGDRIIQINGIEVQNREEAVALLTSEENKNFSLLIARPELQLDEGWMDDDRNDFLDDLHMDMLEEQHHQAMQFTASVLQQKKHDEDGGTTDTATILSNQHEKDSGVGRTDESTRNDESSEQENNGDDATASSNPLAGQRKLTCSQDTLGSGDLPFSNESFISADCTDADYLGIPVDECERFRELLELKCQVKSATPYGLYYPSGPLDAGKSDPESVDKELELLNEELRSIELECLSIVRAHKMQQLKEQYRESWMLHNSGFRNYNTSIDVRRHELSDITELPEKSDKDSSSAYNTGESCRSTPLTLEISPDNSLRRAAEGISCPSSEGAVGTTEAYGPASKNLLSITEDPEVGTPTYSPSLKELDPNQPLESKERRASDGSRSPTPSQKLGSAYLPSYHHSPYKHAHIPAHAQHYQSYMQLIQQKSAVEYAQSQMSLVSMCKDLSSPTPSEPRMEWKVKIRSDGTRYITKRPVRDRLLRERALKIREERSGMTTDDDAVSEMKMGRYWSKEERKQHLVKAKEQRRRREFMMQSRLDCLKEQQAADDRKEMNILELSHKKMMKKRNKKIFDNWMTIQELLTHGTKSPDGTRVYNSFLSVTTV

SEQ ID NO: 61672 - protein, 382 aa, Homo sapiens
  Payload ID: 12312
  Gene Symbol: PDZRN3
  Gene Name: PDZ domain containing ring finger 3
  ENSP ID: ENSP00000419095
  MOD_RES (1)..(1): Any amino acid
XDIHQEMDREELELEEVDLYRMNSQDKLGLTVCYRTDDEDDIGIYISEIDPNSIAAKDGRIREGDRIIQINGIEVQNREEAVALLTSEENKNFSLLIARPELQLDEGWMDDDRNDFLDDLHMDMLEEQHHQAMQFTASVLQQKKHDEDGGTTDTATILSNQHEKDSGVGRTDESTRNDESSEQENNGDDATASSNPLAGQRKLTCSQDTLGSGDLPFSNESFISADCTDADYLGIPWKVKIRSDGTRYITKRPVRDRLLRERALKIREERSGMTTDDDAVSEMKMGRYWSKEERKQHLVKAKEQRRRREFMMQSRLDCLKEQQAADDRKEMNILELSHKKMMKKRNKKIFDNWMTIQELLTHGTKSPDGTRVYNSFLSVTTV

SEQ ID NO: 61673 - protein, 492 aa, Homo sapiens
  Payload ID: 12312
  Gene Symbol: PDZRN3
  Gene Name: PDZ domain containing ring finger 3
  ENSP ID: ENSP00000419250
MINQVNGRDLSRATHDQAVEAFKTAKEPIVVQVLRRTPRTKMFTPPSESQLVDTGTQTDITFEHIMALTKMSSPSPPVLDPYLLPEEHPSAHEYYDPNDYIGDIHQEMDREELELEEVDLYRMNSQDKLGLTVCYRTDDEDDIGIYISEIDPNSIAAKDGRIREGDRIIQINGIEVQNREEAVALLTSEENKNFSLLIARPELQLDEGWMDDDRNDFLDDLHMDMLEEQHHQAMQFTASVLQQKKHDEDGGTTDTATILSNQHEKDSGVGRTDESTRNDESSEQENNGDDATASSNPLAGQRKLTCSQDTLGSGDLPFSNESFISADCTDADYLGIPVDECERFRELLELKCQVKSATPYGLYYPSGPLDAGKSDPESVDKELELLNEELRSIELECLSIVRAHKMQQLKEQYRESWMLHNSGFRNYNTSIDVRRHELSDITELPEKSDKDSSSAYNTGESCRSTPLTLEISPDNSLRRAAEGISCPSSEGA

SEQ ID NO: 61674 - protein, 776 aa, Homo sapiens
  Payload ID: 12313
  Gene Symbol: PDZRN4
  Gene Name: PDZ domain containing ring finger 4
  Uniprot ID: Q6ZMN7
  ENSP ID: ENSP00000298919
MSGKRQFFLKPLALLTCWPSTVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 61675 - protein, 1036 aa, Homo sapiens
  Payload ID: 12313
  Gene Symbol: PDZRN4
  Gene Name: PDZ domain containing ring finger 4
  Uniprot ID: Q6ZMN7
  ENSP ID: ENSP00000384197
MGFALERFAEAVDPALECKLCGQVLEEPLCTPCGHVFCASCLLPWAVRRRRCPLQCQPLAPGELYRVLPLRSLIQKLRVQCDYRARGCGHSVRLHELEAHVEHCDFGPARRLRSRGGCASGLGGGEVPARGGCGPTPRAGRGGGARGGPPGGRWGRGRGPGPRVLAWRRREKALLAQLWALQGEVQLTARRYQEKFTQYMAHVRNFVGDLGGGHRRDGEHKPFTIVLERENDTLGFNIIGGRPNQNNQEGTSTEGIYVSKILENGPADRADGLEIHDKIMEVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 61676 - protein, 778 aa, Homo sapiens
  Payload ID: 12313
  Gene Symbol: PDZRN4
  Gene Name: PDZ domain containing ring finger 4
  Uniprot ID: Q6ZMN7
  ENSP ID: ENSP00000439990
MGCNLCTFQKREEHYKLLYEVSQVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 61677 - protein, 114 aa, Homo sapiens
  Payload ID: 12314
  Gene Symbol: PDZK1IP1
  Gene Name: PDZK1 interacting protein 1
  Uniprot ID: Q13113
  ENSP ID: ENSP00000294338
MSALSLLILGLLTAVPPASCQQGLGNLQPWMQGLIAVAVFLVLVAIAFAVNHFWCQEEPEPAHMILTVGNKADGVLVGTDGRYSSMAASFRSSEHENAYENVPEEEGKVRSTPM

SEQ ID NO: 61678 - protein, 114 aa, Homo sapiens; identical to SEQ ID NO: 61677
  Payload ID: 12314
  Gene Symbol: PDZK1IP1
  Gene Name: PDZK1 interacting protein 1
  Uniprot ID: Q13113
  ENSP ID: ENSP00000360952

SEQ ID NO: 61679 - protein, 2341 aa, Homo sapiens
  Payload ID: 12315
  Gene Symbol: PCNX
  Gene Name: pecanex homolog (Drosophila)
  Uniprot ID: Q96RV3
  ENSP ID: ENSP00000304192
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSLSSACDTEVASLVPLHSHSYRKDHRPRGVPRTSSSAVAFPDTSLNDFPLYQQRRGLDPVSELESSKPLSGSKESLVENSGLSGEFQLAGDLKINTSQPPTKSGKSKPLKAEKSMDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGAAQASEEAVSFRRERSTFRRQAVRRRHNAGSNPTPPTLLIGSPLSLQDGQQGQQSTAQVKVQSRPPSQAAVLSASASLLVRNGSVHLEASHDNASAVGGSSLHDELGKFSSTLYETGGCDMSLVNFEPAARRASNICDTDSHVSSSTSVRFYPHDVLSLPQIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGSDDNNLNSIFYEHLTRSLQHSLCGDLLLGRWGNYSTGDCFILASDYLNALVHLIEIGNGLVTFQLRGLEFRGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSRKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 61680 - protein, 2230 aa, Homo sapiens
  Payload ID: 12315
  Gene Symbol: PCNX
  Gene Name: pecanex homolog (Drosophila)
  Uniprot ID: Q96RV3
  ENSP ID: ENSP00000396617
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSLSSACDTEVASLVPLHSHSYRKDHRPRGVPRTSSSAVAFPDTSLNDFPLYQQRRGLDPVSELESSKPLSGSKESLVENSGLSGEFQLAGDLKINTSQPPTKSGKSKPLKAEKSMDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGGKFSSTLYETGGCDMSLVNFEPAARRASNICDTDSHVSSSTSVRFYPHDVIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGSDDNNLNSIFYEHLTRSLQHSLCGDLLLGRWGNYSTGDCFILASDYLNALVHLIEIGNGLVTFQLRGLEFRGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSRKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 61681 - protein, 95 aa, Homo sapiens
  Payload ID: 12315
  Gene Symbol: PCNX
  Gene Name: pecanex homolog (Drosophila)
  ENSP ID: ENSP00000450947
KAEVIYRVQIVDPSQILEGINLSKRKELQWPDEGIRLKAGRNSWKDWSPQEGMEGHVIHRWVPCSRDPGIGKREEQAEDACRYHFDPMWERLKIE

SEQ ID NO: 61682 - protein, 1328 aa, Homo sapiens
  Payload ID: 12315
  Gene Symbol: PCNX
  Gene Name: pecanex homolog (Drosophila)
  ENSP ID: ENSP00000451016
  MOD_RES (1)..(1): Any amino acid
XDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSRKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 61683 - protein, 199 aa, Homo sapiens
  Payload ID: 12315
  Gene Symbol: PCNX
  Gene Name: pecanex homolog (Drosophila)
  ENSP ID: ENSP00000452517
  MOD_RES (1)..(1): Any amino acid
XFMSILFNKLWELLYKLQFVYTYIAPWQITWGSAFHAFAQPFAVPHSAMLFIQAAVSAFFSTPLNPFLGSAIFITSYVRPVKFWERDYKVLPLSSRLECNDTISTHCNLRLPECNGAILIHCNLRLPGTYCQQREVEAITEGVEEDEGFCCCEPGHIPHMLSFNAAFSQRWLAWEVIVTKYILEGYSITDNSAASMLQV

SEQ ID NO: 61684 - protein, 2137 aa, Homo sapiens
  Payload ID: 12316
  Gene Symbol: PCNXL2
  Gene Name: pecanex-like 2 (Drosophila)
  Uniprot ID: A6NKB5
  ENSP ID: ENSP00000258229
MVSQVLQLLRQGVWAALTGGWYHDPEQSKFTNSCHLYLWLFLLLLPLALHLAFPPNAIIVFFYCSAVTIFFTIIKLVSYRLHLMFDKGEVIQQKPSRKEEKPNKDKEAKGEHITNHRNPSNNRQIHNGKKEEASRNLSTPPLRCSSRGQSITSHHSSGPLELSAQETVEDLKGVILLEDHPIAPVSSTSPGIKVESLPASQAHMLETTTKSVIPVKPVATETLINGKGKERGGKGQPPLRHRSEGGLVDKGPLKKLPHLSLSQYDLLETDVSFQPWGSENSVLIPEPVSCPRGSIRERVQSKSPQDSLSSSCPQCDTIVAKPVEEPADTSCQVDTSCQGDLPLHQEVDSSDSEVAVTLIDTSQPGDPLSLHEPIKIVITMSSTPNSMTDLESSLHLRVVGTEKTSVKSDAEPTNPGAAGSPNAEQISIPVITLDLPEGGGGGVPCPEGNGSERTPERLKTRVSTNQCSGYGSGEGGNAIKDHSSSSREPWESVSRLTPDTGSESKVGKEGQTNLDPSSCKSSHEKRHARVLSVDSGTDVFLSKSSAEIVNDTEKTMPTSKSDLEAKEGQMPNESNFLEFVSLLESINTSKMTASSQLNGSAEQNEESGLLRDNCSQEKKEEILENEKPSGHSSKQGKPDLQSQDHTSTGPACTQPAKTTAFFQGNRQRQIIYRVTSQQDSSVLQVISGPETSVQEEISVDAMHVFIDEHGEIRSCYLKSGNQKEGPLQPLPSNNDCLSQAREMQVSSSSTTTSESQDPSSGDPAVSALQQQLLLMVARRTQSETPRHVSQDLEASSCSSTQGKFNREQFYKFIIFPGKWIKVWYDRLTLLALLDRTEDIKENVLAILLIVLVSLLGFLTLSQGFCKDMWVLLFCLVMASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKLGDLLHKLQFVLTYVAPWQMAWGSSFHVFAQLFAIPHSAMLFFQTIATSIFSTPLSPFLGSVIFITSYVRPVKFWEKNYNTRRVDNSNTRLAVQIERDPGNDDNNLNSIFYEHLTRTLQESLCGDLVLGRWGNYSSGDCFILASDDLNAFVHLIEIGNGLVTFQLRGLEFRGTYCQQREVEAIMEGDEEDRGCCCCKPGHLPHLLSCNAAFHLRWLTWEITQTQYILEGYSILDNNAATMLQVFDLRRILIRYYIKSIIYYMVTSPKLLSWIKNESLLKSLQPFAKWHYIERDLAMFNINIDDDYVPCLQGITRASFCNVYLEWIQHCARKRQEPSTTLDSDEDSPLVTLSFALCTLGRRALGTAAHNMAISLDSFLYGLHVLFKGDFRITARDEWVFADMDLLHKVVAPAIRMSLKLHQDQFTCPDEYEDPAVLYEAIQSFEKKVVICHEGDPAWRGAVLSNKEELLTLRHVVDEGADEYKVIMLHRSFLSFKVIKVNKECVRGLWAGQQQELIFLRNRNPERGSIQNNKQVLRNLINSSCDQPLGYPMYVSPLTTSYLGTHRQLKNIWGGPITLDRIRTWFWTKWVRMRKDCNARQHSGGNIEDVDGGGAPTTGGNNAPSGGSQESSAEQPRKGGAQHGVSSCEGTQRTGRRKGRSQSVQAHSALSQRPPMLSSSGPILESRQTFLQTSTSVHELAQRLSGSRLSLHASATSLHSQPPPVTTTGHLSVRERAEALIRSSLGSSTSSTLSFLFGKRSFSSALVISGLSAAEGGNTSDTQSSSSVNIVMGPSARAASQATRHLSEPCEPPDATEQGQLHDRCLAEAVADTLGVVCRRASQEDMGLDDTASQQSVSDEQ

SEQ ID NO: 61685 - protein, 777 aa, Homo sapiens
  Payload ID: 12316
  Gene Symbol: PCNXL2
  Gene Name: pecanex-like 2 (Drosophila)
  Uniprot ID: A6NKB5
  ENSP ID: ENSP00000340759
MTFYPFVASSSTRRVDNSNTRLAVQIERDPGNDDNNLNSIFYEHLTRTLQESLCGDLVLGRWGNYSSGDCFILASDDLNAFVHLIEIGNGLVTFQLRGLEFRGTYCQQREVEAIMEGDEEDRGCCCCKPGHLPHLLSCNAAFHLRWLTWEITQTQYILEGYSILDNNAATMLQVFDLRRILIRYYIKSIIYYMVTSPKLLSWIKNESLLKSLQPFAKWHYIERDLAMFNINIDDDYVPCLQGITRASFCNVYLEWIQHCARKRQEPSTTLDSDEDSPLVTLSFALCTLGRRALGTAAHNMAISLDSFLYGLHVLFKGDFRITARDEWVFADMDLLHKVVAPAIRMSLKLHQDQFTCPDEYEDPAVLYEAIQSFEKKVVICHEGDPAWRGAVLSNKEELLTLRHVVDEGADEYKVIMLHRSFLSFKVIKVNKECVRGLWAGQQQELIFLRNRNPERGSIQNNKQVLRNLINSSCDQPLGYPMYVSPLTTSYLGTHRQLKNIWGGPITLDRIRTWFWTKWVRMRKDCNARQHSGGNIEDVDGGGAPTTGGNNAPSGGSQESSAEQPRKGGAQHGVSSCEGTQRTGRRKGRSQSVQAHSALSQRPPMLSSSGPILESRQTFLQTSTSVHELAQRLSGSRLSLHASATSLHSQPPPVTTTGHLSVRERAEALIRSSLGSSTSSTLSFLFGKRSFSSALVISGLSAAEGGNTSDTQSSSSVNIVMGPSARAASQATRVRGWAGLTRTGWDGGTGSWPERGTCLAFPPFCLQNPIPFSMGLPE

SEQ ID NO: 61686 - protein, 412 aa, Homo sapiens
  Payload ID: 12316
  Gene Symbol: PCNXL2
  Gene Name: pecanex-like 2 (Drosophila)
  ENSP ID: ENSP00000394703
MWVLLFCLVMASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSK

SEQ ID NO: 61687 - protein, 109 aa, Homo sapiens
  Payload ID: 12316
  Gene Symbol: PCNXL2
  Gene Name: pecanex-like 2 (Drosophila)
  ENSP ID: ENSP00000427962
  MOD_RES (1)..(1): Any amino acid
XFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKDGTHTQRG

SEQ ID NO: 61688 - protein, 178 aa, Homo sapiens
  Payload ID: 12316
  Gene Symbol: PCNXL2
  Gene Name: pecanex-like 2 (Drosophila)
  ENSP ID: ENSP00000428134
EYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKLGDLLHKLQFVLTYVAPWQMAWGSSFHVFAQLFAIPRILSASIFTLQLRFTFYGSKLFIDPWQ

SEQ ID NO: 61689 - protein, 490 aa, Homo sapiens
  Payload ID: 12316
  Gene Symbol: PCNXL2
  Gene Name: pecanex-like 2 (Drosophila)
  ENSP ID: ENSP00000428488
  MOD_RES (1)..(1): Any amino acid
XLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKLGDLLHKLQFVLTYVAPWQMAWGSSFHVFAQLFAIPHSAMLFFQTIATSIFSTPLSPFLGSVIFITSYVRPVKFWEKNYNTRRVDNSNTRLAVQIERDPGNDDNNLNSIFYEHLTRTLQESLCGDLVLGRWGNYSSGDCFILASDDLNAFVHLIEIGNGLVTFQLRGLEFREYNILYGNVSQTPLLDQK

SEQ ID NO: 61690 - protein, 47 aa, Homo sapiens
  Payload ID: 12316
  Gene Symbol: PCNXL2
  Gene Name: pecanex-like 2 (Drosophila)
  ENSP ID: ENSP00000428582
  MOD_RES (1)..(1): Any amino acid
XDPLPKKMKDSVTDVLKWDLIVCAVVAVLSFAVSASTVFLSLRMLPI

SEQ ID NO: 61691 - protein, 181 aa, Homo sapiens
  Payload ID: 12316
  Gene Symbol: PCNXL2
  Gene Name: pecanex-like 2 (Drosophila)
  ENSP ID: ENSP00000429231
KVWYDRLTLLALLDRTEDIKENVLAILLIVLVSLLGFLTLSQGFCKDMWVLLFCLVMASCQYSLLKGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAAL

SEQ ID NO: 61692 - protein, 45 aa, Homo sapiens
  Payload ID: 12316
  Gene Symbol: PCNXL2
  Gene Name: pecanex-like 2 (Drosophila)
  ENSP ID: ENSP00000429262
  MOD_RES (1)..(1): Any amino acid
XMWVLLFCLVMASCQYSLLKSVQPDPASPIHGPKPGTLPVTLCMA

SEQ ID NO: 61693 - protein, 218 aa, Homo sapiens
  Payload ID: 12316
  Gene Symbol: PCNXL2
  Gene Name: pecanex-like 2 (Drosophila)
  ENSP ID: ENSP00000429360
  MOD_RES (1)..(1): Any amino acid
XPNESNFLEFVSLLESINTSKMTASSQLNGSAEQNEESGLLRDNCSQEKKEEILENEKPSGHSSKQGKPDLQSQDHTSTGPACTQPAKTTAFFQGNRQRQIIYRVTSQQDSSVLQVISGPETSVQEEISVDAMHVFIDEHGEIRSCYLKSGNQKEGPLQPLPSNNDCLSQAREMQVSSSSTTTSESQDPSSGDPAVSALQQQLLLMVARRTQSETPRN

SEQ ID NO: 61694 - protein, 424 aa, Homo sapiens
  Payload ID: 12316
  Gene Symbol: PCNXL2
  Gene Name: pecanex-like 2 (Drosophila)
  ENSP ID: ENSP00000430820
MWVLLFCLVMASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKASELAIFFILTF

SEQ ID NO: 61695 - protein, 2034 aa, Homo sapiens
  Payload ID: 12317
  Gene Symbol: PCNXL3
  Gene Name: pecanex-like 3 (Drosophila)
  Uniprot ID: Q9H6A9
  ENSP ID: ENSP00000347931
MGSQVLQILRQGVWASLTGGWFFDPHQSTFSNCFHLYVWIFLLIFPFLLYMVLPPSLMVAGVYCLVVAVIFATIKTVNYRLHAMFDQGEIVEKRSSTMGELEEEPAQGDSNPPRDPGVEMTVFRKVSSTPPVRCSSQHSVFGFNQVSELLPRMEDSGPLRDIKELVREQGSNNVIVTSADREMLKLSSQEKLIGDLPQTPPGAVPDPSLASTDSSEPSPLAGDGAPWSGSSMADTPMSPLLKGSLSQELSKSFLTLTQPDRALVRTSSRREQRRGAGGYQPLDRRGSGEPTPQKAGSSDSCFSGTDRETLSSFKSEKTNSTHLDSPPGGPAPEGSDTDPPSEAELPASPDAGVPSDDTLRSFDTVIGAGTPPGLAEPLLVVRPKDLALLRPSKRQPPLRRHSPPGRAPRRPLLEGGGFFEDEDTSEGSELSPASSLRSQRRYSTDSSSSTSCYSPESSRGAAGGPRKRRAPHGAEEGTAVPPKRPYGTQRTPSTASAKTHARVLSMDGAGGDVLRPPLAGCKAELEAQVGVEQAASEPVVLPAEARRGPAANQPGWRGELQEEGAVGGAAEETGRRDRSSSVRRTQAIRRRHNAGSNPTPPASVMGSPPSSLQEAQRGRAASHSRALTLPSALHFASSLLLTRAGANVHEACTFDDTSEGAVHYFYDESGVRRSYTFGLAGGGYENPVGQQGEQTANGAWDRHSHSSSFHSADVPEATGGLNLLQPRPVVLQGMQVRRVPLEIPEEQTLMEEAPPRAQHSYKYWLLPGRWTSVRYERLALLALLDRTRGVLENIFGVGLSSLVAFLGYLLLLKGFFTDIWVFQFCLVIASCQYSLLKSVQPDAASPMHGHNWVIAYSRPVYFCICCLLIWLLDALGSAQPFPPVSLYGLTLFSASFFFCARDVATVFTLCFPFVFLLGLLPQVNTCLMYLLEQIDMHGFGGTAATSPLTAVFSLSRSLLAAALLYGFCLGAIKTPWPEQHVPVLFSVFCGLLVALSYHLSRQSSDPTVLWSLIRSKLFPELEERSLETARAEPPDPLPDKMRQSVREVLHSDLVMCVVIAVLTFAISASTVFIALKSVLGFVLYALAGAVGFFTHYLLPQLRKQLPWFCLSQPVLKPLEYSQYEVRGAAQVMWFEKLYAGLQCVEKYLIYPAVVLNALTVDAHTVVSHPDKYCFYCRALLMTVAGLKLLRSAFCCPPQQYLTLAFTVLLFHFDYPRLSQGFLLDYFLMSLLCSKLWDLLYKLRFVLTYIAPWQITWGSAFHAFAQPFAVPHSAMLFVQALLSGLFSTPLNPLLGSAVFIMSYARPLKFWERDYNTKRVDHSNTRLVTQLDRNPGADDNNLNSIFYEHLTRSLQHTLCGDLVLGRWGNYGPGDCFVLASDYLNALVHLIEVGNGLVTFQLRGLEFRGTYCQQREVEAITEGVEEDEGCCCCEPGHLPRVLSFNAAFGQRWLAWEVTASKYVLEGYSISDNNAASMLQVFDLRKILITYYVKSIIYYVSRSPKLEVWLSHEGITAALRPVRVPGYADSDPTFSLSVDEDYDLRLSGLSLPSFCAVHLEWIQYCASRRSQPVDQDWNSPLVTLCFGLCVLGRRALGTASHSMSASLEPFLYGLHALFKGDFRITSPRDEWVFADMDLLHRVVAPGVRMALKLHQDHFTSPDEYEEPAALYDAIAANEERLVISHEGDPAWRSAILSNTPSLLALRHVLDDASDEYKIIMLNRRHLSFRVIKVNRECVRGLWAGQQQELVFLRNRNPERGSIQNAKQALRNMINSSCDQPLGYPIYVSPLTTSLAGSHPQLRALWGGPISLGAIAHWLLRTWERLHKGCGAGCNSGGNVDDSDCSGGGGLTSLSNNPPVAHPTPENTAGNGDQPLPPGPGWGPRSSLSGSGDGRPPPLLQWPPPRLPGPPPASPIPTEGPRTSRPPGPGLLSSEGPSGKWSLGGRKGLGGSDGEPASGSPKGGTPKSQAPLDLSLSLSLSLSPDVSTEASPPRASQDIPCLDSSAPESGTPMGALGDWPAPIEERESPAAQPLLEHQY

SEQ ID NO: 61696 - protein, 938 aa, Homo sapiens
  Payload ID: 12318
  Gene Symbol: PCNXL4
  Gene Name: pecanex-like 4 (Drosophila)
  ENSP ID: ENSP00000317396
MPALEHMNQILHILFVFLPFLWALGTLPPPDALLLWAMEQVLEFGLGGSSMSTHLRLLVMFIMSAGTAIASYFIPSTVGVVLFMTGFGFLLSLNLSDMGHKIGTKSKDLPSGPEKHFSWKECLFYIIILVLALLETSLLHHFAGFSQISKSNSQAIVGYGLMILLIILWILREIQSVYIIGIFRNPFYPKDVQTVTVFFEKQTRLMKIGIVRRILLTLVSPFAMIAFLSLDSSLQGLHSVSVCIGFTRAFRMVWQNTENALLETVIVSTVHLISSTDIWWNRSLDTGLRLLLVGIIRDRLIQFISKLQFAVTVLLTSWTEKKQRRKTTATLCILNIVFSPFVLVIIVFSTLLSSPLLPLFTLPVFLVGFPRPIQSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMGIYTGRVLSLQELLIQVGKLNPEAVRGQWANLSWELLYATNDDEERYSIQAHPLLLRNLTVQAAEPPLGYPIYSSKPLHIHLY

SEQ ID NO: 61697 - protein, 230 aa, Homo sapiens
  Payload ID: 12318
  Gene Symbol: PCNXL4
  Gene Name: pecanex-like 4 (Drosophila)
  ENSP ID: ENSP00000375469
MSPDVPLLNDYKQDFFLKRFPQTVLGGPRFKLGYCAPPYIYVNQIILFLMPWVWGGVGTLLYQLGILKDYYTAALSGGLMLFTAFVIQFTSLYAKNKSTTVERILTTDILAEEDEHEFTSCTGAETVKFLIPGKKYVANTVFHSILAGLACGLGTWYLLPNRITLLYGSTGGTALLFFFGWMTLCIAEYSLIVNTATETATFQTQDTYEIIPLMRPLYIFFFVSVDLAHR

SEQ ID NO: 61698 - protein, 1172 aa, Homo sapiens
  Payload ID: 12318
  Gene Symbol: PCNXL4
  Gene Name: pecanex-like 4 (Drosophila)
  Uniprot ID: Q63HM2
  ENSP ID: ENSP00000384801
MSPDVPLLNDYKQDFFLKRFPQTVLGGPRFKLGYCAPPYIYVNQIILFLMPWVWGGVGTLLYQLGILKDYYTAALSGGLMLFTAFVIQFTSLYAKNKSTTVERILTTDILAEEDEHEFTSCTGAETVKFLIPGKKYVANTVFHSILAGLACGLGTWYLLPNRITLLYGSTGGTALLFFFGWMTLCIAEYSLIVNTATETATFQTQDTYEIIPLMRPLYIFFFVSVDLAHRFVVNMPALEHMNQILHILFVFLPFLWALGTLPPPDALLLWAMEQVLEFGLGGSSMSTHLRLLVMFIMSAGTAIASYFIPSTVGVVLFMTGFGFLLSLNLSDMGHKIGTKSKDLPSGPEKHFSWKECLFYIIILVLALLETSLLHHFAGFSQISKSNSQAIVGYGLMILLIILWILREIQSVYIIGIFRNPFYPKDVQTVTVFFEKQTRLMKIGIVRRILLTLVSPFAMIAFLSLDSSLQGLHSVSVCIGFTRAFRMVWQNTENALLETVIVSTVHLISSTDIWWNRSLDTGLRLLLVGIIRDRLIQFISKLQFAVTVLLTSWTEKKQRRKTTATLCILNIVFSPFVLVIIVFSTLLSSPLLPLFTLPVFLVGFPRPIQSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMGIYTGRVLSLQELLIQVGKLNPEAVRGQWANLSWELLYATNDDEERYSIQAHPLLLRNLTVQAAEPPLGYPIYSSKPLHIHLY

SEQ ID NO: 61699 - protein, 873 aa, Homo sapiens
  Payload ID: 12318
  Gene Symbol: PCNXL4
  Gene Name: pecanex-like 4 (Drosophila)
  ENSP ID: ENSP00000385201
MPALEHMNQILHILFVFLPFLWALGTLPPPDALLLWAMEQVLEFGLGGSSMSTHLRLLVMFIMSAGTAIASYFIPSTVGVVLFMTGFGFLLSLNLSDMGHKIGTKSKDLPSGPEKHFSWKECLFYIIILVLALLETSLLHHFAGFSQISKSNSQAIVGYGLMILLIILWILREIQSVYIIGIFRNPFYPKDVQTVTVFFEKQTRLMKIGIVRRILLTLVSPFAMIAFLSLDSSLQGLHSVSVCIGFTRAFRMVWQNTENALLETVIVSTVHLISSTDIWWNRSLDTGLRLLLVGIIRDRLIQFISKLQFAVTVLLTSWTEKKQRRKTTATLCILNIVFSPFVLVIIVFSTLLSSPLLPLFTLPVFLVGFPRPIQSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMPGPALEISRVNRNLWSQI

SEQ ID NO: 61700 - protein, 527 aa, Homo sapiens
  Payload ID: 12318
  Gene Symbol: PCNXL4
  Gene Name: pecanex-like 4 (Drosophila)
  ENSP ID: ENSP00000450441
LCILNIVFSPFVLVIIVFSTLLSSPLLPLFTLPVFLVGFPRPIQSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMYL

SEQ ID NO: 61701 - protein, 139 aa, Homo sapiens
  Payload ID: 12318
  Gene Symbol: PCNXL4
  Gene Name: pecanex-like 4 (Drosophila)
  ENSP ID: ENSP00000450994
  MOD_RES (1)..(1): Any amino acid
XRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGIL

SEQ ID NO: 61702 - protein, 119 aa, Homo sapiens
  Payload ID: 12318
  Gene Symbol: PCNXL4
  Gene Name: pecanex-like 4 (Drosophila)
  ENSP ID: ENSP00000451836
  MOD_RES (1)..(1): Any amino acid
XVSTVHLISSTDIWWNRSLDTGLRLLLSWPGAAGTTACVCADTVYYYQMVPRLTAVLQTAMAAGSLGLLLPGSHYLGRFQDRLMWIMILECGYTYCSINIKGLELQETSCHTAEARRVD

SEQ ID NO: 61703 - protein, 96 aa, Homo sapiens
  Payload ID: 12318
  Gene Symbol: PCNXL4
  Gene Name: pecanex-like 4 (Drosophila)
  ENSP ID: ENSP00000452234
  MOD_RES (1)..(1): Any amino acid
XYYYQMVPRLTAVLQTAMAAGSLGLLLPGSHYLGRFQDRLMWIMILECGYTYCSINIKGLELQETSCHTAEARRVDEVFEDAFEQEYTRVYSETND

SEQ ID NO: 61704 - protein, 418 aa, Homo sapiens
  Payload ID: 12319
  Gene Symbol: PELI1
  Gene Name: pellino E3 ubiquitin protein ligase 1
  Uniprot ID: Q96FA3
  ENSP ID: ENSP00000351789
MFSPDQENHPSKAPVKYGELIVLGYNGSLPNGDRGRRKSRFALFKRPKANGVKPSTVHIACTPQAAKAISNKDQHSISYTLSRAQTVVVEYTHDSNTDMFQIGRSTESPIDFVVTDTVPGSQSNSDTQSVQSTISRFACRIICERNPPFTARIYAAGFDSSKNIFLGEKAAKWKTSDGQMDGLTTNGVLVMHPRNGFTEDSKPGIWREISVCGNVFSLRETRSAQQRGKMVEIETNQLQDGSLIDLCGATLLWRTAEGLSHTPTVKHLEALRQEINAARPQCPVGFNTLAFPSMKRKDVVDEKQPWVYLNCGHVHGYHNWGNKEERDGKDRECPMCRSVGPYVPLWLGCEAGFYVDAGPPTHAFSPCGHVCSEKTTAYWSQIPLPHGTHTFHAACPFCAHQLAGEQGYIRLIFQGPLD

SEQ ID NO: 61705 - protein, 420 aa, Homo sapiens
  Payload ID: 12320
  Gene Symbol: PELI2
  Gene Name: pellino E3 ubiquitin protein ligase family member 2
  Uniprot ID: Q9HAT8
  ENSP ID: ENSP00000267460
MFSPGQEEHCAPNKEPVKYGELVVLGYNGALPNGDRGRRKSRFALYKRPKANGVKPSTVHVISTPQASKAISCKGQHSISYTLSRNQTVVVEYTHDKDTDMFQVGRSTESPIDFVVTDTISGSQNTDEAQITQSTISRFACRIVCDRNEPYTARIFAAGFDSSKNIFLGEKAAKWKNPDGHMDGLTTNGVLVMHPRGGFTEESQPGVWREISVCGDVYTLRETRSAQQRGKLVESETNVLQDGSLIDLCGATLLWRTADGLFHTPTQKHIEALRQEINAARPQCPVGLNTLAFPSINRKEVVEEKQPWAYLSCGHVHGYHNWGHRSDTEANERECPMCRTVGPYVPLWLGCEAGFYVDAGPPTHAFTPCGHVCSEKSAKYWSQIPLPHGTHAFHAACPFCATQLVGEQNCIKLIFQGPID

SEQ ID NO: 61706 - protein, 94 aa, Homo sapiens
  Payload ID: 12320
  Gene Symbol: PELI2
  Gene Name: pellino E3 ubiquitin protein ligase family member 2
  ENSP ID: ENSP00000452666
MFQVGRSTESPIDFVVTDTISGSQNTDEAQITQSTISRFACRIVCDRNEPYTARIFAAGFDSSKNIFLGEKAAKWKNPDGHMDGLTTNGVLVMH

SEQ ID NO: 61707 - protein, 77 aa, Homo sapiens
  Payload ID: 12320
  Gene Symbol: PELI2
  Gene Name: pellino E3 ubiquitin protein ligase family member 2
  ENSP ID: ENSP00000453988
MFQVGRSTESPIDFVVTDTISGSQNTDEAQITQSTISRFACRIVCDRNEPYTARIFAAGFDSSKNIFLGEKAAKWKN

SEQ ID NO: 61708 - protein, 445 aa, Homo sapiens
  Payload ID: 12321
  Gene Symbol: PELI3
  Gene Name: pellino E3 ubiquitin protein ligase family member 3
  Uniprot ID: Q8N2H9
  ENSP ID: ENSP00000309848
MVLEGNPEVGSPRTSDLQHRGNKGSCVLSSPGEDAQPGEEPIKYGELIVLGYNGCLASGDKGRRRSRLALSRRSHANGVKPDVMHHISTPLVSKALSNRGQHSISYTLSRSHSVIVEYTHDSDTDMFQIGRSTENMIDFVVTDTSPGGGAAEGPSAQSTISRYACRILCDRRPPYTARIYAAGFDASSNIFLGERAAKWRTPDGLMDGLTTNGVLVMHPAGGFSEDSAPGVWREISVCGNVYTLRDSRSAQQRGKLVENESNVLQDGSLIDLCGATLLWRTPAGLLRAPTLKQLEAQRQEANAARPQCPVGLSTLAFPSPARGRTAPDKQQPWVYVRCGHVHGYHGWGCRRERGPQERECPLCRLVGPYVPLWLGQEAGLCLDPGPPSHAFAPCGHVCSEKTARYWAQTPLPHGTHAFHAACPFCGAWLTGEHGCVRLIFQGPLD

SEQ ID NO: 61709 - protein, 469 aa, Homo sapiens
  Payload ID: 12321
  Gene Symbol: PELI3
  Gene Name: pellino E3 ubiquitin protein ligase family member 3
  Uniprot ID: Q8N2H9
  ENSP ID: ENSP00000322532
MVLEGNPEVGSPRTSDLQHRGNKGSCVLSSPGEDAQPGEEPIKYGELIVLGCCEEGGEETEAQRGEVTGPRAHSCYNGCLASGDKGRRRSRLALSRRSHANGVKPDVMHHISTPLVSKALSNRGQHSISYTLSRSHSVIVEYTHDSDTDMFQIGRSTENMIDFVVTDTSPGGGAAEGPSAQSTISRYACRILCDRRPPYTARIYAAGFDASSNIFLGERAAKWRTPDGLMDGLTTNGVLVMHPAGGFSEDSAPGVWREISVCGNVYTLRDSRSAQQRGKLVENESNVLQDGSLIDLCGATLLWRTPAGLLRAPTLKQLEAQRQEANAARPQCPVGLSTLAFPSPARGRTAPDKQQPWVYVRCGHVHGYHGWGCRRERGPQERECPLCRLVGPYVPLWLGQEAGLCLDPGPPSHAFAPCGHVCSEKTARYWAQTPLPHGTHAFHAACPFCGAWLTGEHGCVRLIFQGPLD

SEQ ID NO: 61710 - protein, 119 aa, Homo sapiens
  Payload ID: 12321
  Gene Symbol: PELI3
  Gene Name: pellino E3 ubiquitin protein ligase family member 3
  ENSP ID: ENSP00000432449
MVLEGNPEVGSPRTSDLQHRGNKGSCVLSSPGEDAQPGEEPIKYGELIVLGCCEEGGEETEAQRGEVTGPRAHSCYNGCLASGDKGRRRSRLALSRRSHANGVKPDVMHHISTPLVSKA

SEQ ID NO: 61711 - protein, 91 aa, Homo sapiens
  Payload ID: 12321
  Gene Symbol: PELI3
  Gene Name: pellino E3 ubiquitin protein ligase family member 3
  ENSP ID: ENSP00000434314
MVLEGNPEVGSPRTSDLQHRGNKGSCVLSSPGEDAQPGEEPIKYGELIVLGYNGCLASGDKGRRRSRLALSRRSHANGVKPDVMHHISTPL

SEQ ID NO: 61712 - protein, 331 aa, Homo sapiens
  Payload ID: 12321
  Gene Symbol: PELI3
  Gene Name: pellino E3 ubiquitin protein ligase family member 3
  Uniprot ID: Q8N2H9
  ENSP ID: ENSP00000434677
MVLEGNPEVGSPRTSDLQHRGNKGSCVLSSPGEDAQPGEEPIKYGELIVLGCCEEGGEETEAQRGEVTGPRAHSCYNGCLASGDKGRRRSRLALSRRSHANGVKPDVMHHISTPLVSKALSNRGQHSISYTLSRSHSVIVEYTHDSDTDMFQIGRSTENMIDFVVTDTSPGGGAAEGPSAQSTISRYACRILCDRRPPYTARIYAAGFDASSNIFLGERAAKWRTPDGLMDGLTTNGVLVMHPAGGFSEDSAPGVWREISVCGNVYTLRDSRSAQQRGKLVGGPLHSPPLSLPGPHKLPIPLPKPGDDLQSFCPREPQQAPYQGIPGPGGS

SEQ ID NO: 61713 - protein, 67 aa, Homo sapiens
  Payload ID: 12321
  Gene Symbol: PELI3
  Gene Name: pellino E3 ubiquitin protein ligase family member 3
  ENSP ID: ENSP00000436161
IFLGERAAKWRTPDGLMDGLTTNGVLVMHPAGGFSEDSAPGVWREISVCGNVYTLRDSRSAQQRGKL

SEQ ID NO: 61714 - protein, 255 aa, Homo sapiens
  Payload ID: 12321
  Gene Symbol: PELI3
  Gene Name: pellino E3 ubiquitin protein ligase family member 3
  ENSP ID: ENSP00000436722
MHHISTPLVSKALSNRGQHSISYTLSRSHSVIVEYTHDSDTDMFQIGRSTENMIDFVVTDTSPGGGAAEGPSAQSTISRYACRILCDRRPPYTARIYAAGFDASSNIFLGERAAKWRTPDGLMDGLTTNGVLVMHPAGGFSEDSAPGVWREISVCGNVYTLRDSRSAQQRGKLVENESNVLQDGSLIDLCGATLLWRTPAGLLRAPTLKQLEAQRQEANAARPQCPVGLSTLAFPSPARGRTAPDKQQPWVYVRC

SEQ ID NO: 61715 - protein, 406 aa, Homo sapiens
  Payload ID: 12321
  Gene Symbol: PELI3
  Gene Name: pellino E3 ubiquitin protein ligase family member 3
  Uniprot ID: Q8N2H9
  ENSP ID: ENSP00000484220
MVLEGNPEVGSPRTSDLQHRGNKGSCVLSSPGEDAQPGEEPIKYGELISTPLVSKALSNRGQHSISYTLSRSHSVIVEYTHDSDTDMFQIGRSTENMIDFVVTDTSPGGGAAEGPSAQSTISRYACRILCDRRPPYTARIYAAGFDASSNIFLGERAAKWRTPDGLMDGLTTNGVLVMHPAGGFSEDSAPGVWREISVCGNVYTLRDSRSAQQRGKLVENESNVLQDGSLIDLCGATLLWRTPAGLLRAPTLKQLEAQRQEANAARPQCPVGLSTLAFPSPARGRTAPDKQQPWVYVRCGHVHGYHGWGCRRERGPQERECPLCRLVGPYVPLWLGQEAGLCLDPGPPSHAFAPCGHVCSEKTARYWAQTPLPHGTHAFHAACPFCGAWLTGEHGCVRLIFQGPLD

SEQ ID NO: 61716 - protein, 385 aa, Homo sapiens
  Payload ID: 12322
  Gene Symbol: PELO
  Gene Name: pelota homolog (Drosophila)
  Uniprot ID: Q9BRX2
  ENSP ID: ENSP00000274311
MKLVRKNIEKDNAGQVTLVPEEPEDMWHTYNLVQVGDSLRASTIRKVQTESSTGSVGSNRVRTTLTLCVEAIDFDSQACQLRVKGTNIQENEYVKMGAYHTIELEPNRQFTLAKKQWDSVVLERIEQACDPAWSADVAAVVMQEGLAHICLVTPSMTLTRAKVEVNIPRKRKGNCSQHDRALERFYEQVVQAIQRHIHFDVVKCILVASPGFVREQFCDYLFQQAVKTDNKLLLENRSKFLQVHASSGHKYSLKEALCDPTVASRLSDTKAAGEVKALDDFYKMLQHEPDRAFYGLKQVEKANEAMAIDTLLISDELFRHQDVATRSRYVRLVDSVKENAGTVRIFSSLHVSGEQLSQLTGVAAILRFPVPELSDQEGDSSSEED

SEQ ID NO: 61717 - protein, 284 aa, Homo sapiens
  Payload ID: 12323
  Gene Symbol: PEF1
  Gene Name: penta-EF-hand domain containing 1
  Uniprot ID: Q9UBV8
  ENSP ID: ENSP00000362807
MASYPYRQGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 61718 - protein, 700 aa, Homo sapiens
  Payload ID: 12324
  Gene Symbol: PTCD1
  Gene Name: pentatricopeptide repeat domain 1
  Uniprot ID: O75127
  ENSP ID: ENSP00000292478
MDFVRLARLFARARPMGLFILQHLDPCRARWAGGREGLMRPMWAPFSSSSSQLPLGQERQENTGSLGSDPSHSNSTATQEEDEEEEESFGTLSDKYSSRRLFRKSAAQFHNLRFGERRDEQMEPEPKLWRGRRNTPYWYFLQCKHLIKEGKLVEALDLFERQMLKEERLQPMESNYTVLIGGCGRVGYLKKAFNLYNQMKKRDLEPSDATYTALFNVCAESPWKDSALQSALKLRQQLQAKNFELNLKTYHALLKMAAKCADLRMCLDVFKEIIHKGHVVTEETFSFLLMGCIQDKKTGFRYALQVWRLMLSLGLQPSRDSYNLLLVAARDCGLGDPQVASELLLKPREEATVLQPPVSRQRPRRTAQAKAGNLMSAMLHVEALERQLFLEPSQALGPPEPPEARVPGKAQPEVDTKAEPSHTAALTAVALKPPPVELEVNLLTPGAVPPTVVSFGTVTTPADRLALIGGLEGFLSKMAEHRQQPDIRTLTLLAEVVESGSPAESLLLALLDEHQVEADLTFFNTLVRKKSKLGDLEGAKALLPVLAKRGLVPNLQTFCNLAIGCHRPKDGLQLLTDMKKSQVTPNTHIYSALINAAIRKLNYTYLISILKDMKQNRVPVNEVVIRQLEFAAQYPPTFDRYQGKNTYLEKIDGFRAYYKQWLTVMPAEETPHPWQKFRTKPQGDQDTGKEADDGCALGGR

SEQ ID NO: 61719 - protein, 164 aa, Homo sapiens
  Payload ID: 12324
  Gene Symbol: PTCD1
  Gene Name: pentatricopeptide repeat domain 1
  ENSP ID: ENSP00000390530
MDFVRLARLFARARPMGLFILQHLDPCRARWAGGREGLMRPMWAPFSSSSSQLPLGQERQENTGSLGSDPSHSNSTATQEEDEEEEESFGTLSDKYSSRRLFRKSAAQFHNLRFGERRDEQMEPEPKLWRGRRNTPYWYFLQCKHLIKEGKLVEALDLFERQML

SEQ ID NO: 61720 - protein, 106 aa, Homo sapiens
  Payload ID: 12324
  Gene Symbol: PTCD1
  Gene Name: pentatricopeptide repeat domain 1
  ENSP ID: ENSP00000401600
MDFVRLARLFARARPMGLFILQHLDPCRARWAGGREGLMRPMWAPFSSSSSQLPLGQERQENTGSLGSDPSHSNSTATQEEDEEEEESFGTLSDKYSSRRLFRKSA

SEQ ID NO: 61721 - protein, 144 aa, Homo sapiens
  Payload ID: 12324
  Gene Symbol: PTCD1
  Gene Name: pentatricopeptide repeat domain 1
  ENSP ID: ENSP00000408059
MDFVRLARLFARARPMGLFILQHLDPCRARWAGGREGLMRPMWAPFSSSSSQLPLGQERQENTGSLGSDPSHSNSTATQEEDEEEEESFGTLSDKYSSRRLFRKSAAQFHNLRFGERRDEQMEPEPKLWRGRRNTPYWYFLQCK

SEQ ID NO: 61722 - protein, 388 aa, Homo sapiens
  Payload ID: 12325
  Gene Symbol: PTCD2
  Gene Name: pentatricopeptide repeat domain 2
  Uniprot ID: Q8WV60
  ENSP ID: ENSP00000308948
MVRDSMAAAFRPSNRVLLQALQILVYPGVGGSGSVSCRCPLGAKRYLLTDNVVKLKEFQQKKVAVACNLSGTKETYFRNLKKKLTQNKLILKGELITLLHLCESRDHVELAKNVIYRYHAENKNFTLGEYKFGPLFVRLCYELDLEESAVELMKDQHLRGFFSDSTSFNILMDMLFIKGKYKSALQVLIEMKNQDVKFTKDTYVLAFAICYKLNSPESFKICTTLREEALLKGEILSRRASCFAVALALNQNEMAKAVSIFSQIMNPESIACINLNIIIHIQSNMLENLIKTLKNAAEGNLSKFVKRHVFSEEVLAKVREKVKDVPALVAKFDEIYGTLHITGQVTTDSLDAVLCHTPRDRKSHTLLLNKRMVSRRTFQPLSQSLLAE

SEQ ID NO: 61723 - protein, 388 aa, Homo sapiens; identical to SEQ ID NO: 61722
  Payload ID: 12325
  Gene Symbol: PTCD2
  Gene Name: pentatricopeptide repeat domain 2
  Uniprot ID: Q8WV60
  ENSP ID: ENSP00000370013

SEQ ID NO: 61724 - protein, 74 aa, Homo sapiens
  Payload ID: 12325
  Gene Symbol: PTCD2
  Gene Name: pentatricopeptide repeat domain 2
  ENSP ID: ENSP00000425606
MVRDSMAAAFRPSNRVLLQALQILVYPGVGGSGSVSCRCPLGGIRGFSLGKEGRDGREGSVRSQLASLWSSHSS

SEQ ID NO: 61725 - protein, 143 aa, Homo sapiens
  Payload ID: 12325
  Gene Symbol: PTCD2
  Gene Name: pentatricopeptide repeat domain 2
  ENSP ID: ENSP00000425773
MAAAFRPSNRVLLQALQILVYPGVGGSGSVSCRCPLGAKRYLLTDNVVKLKEFQQKKVAVACNLSGTKETYFRNLKKKLTQNKLILKGELITLLHLCESRDHVELAKNVIYRCFASIDRDEKPRCEVHQRYLCSCFCNLLQTE

SEQ ID NO: 61726 - protein, 203 aa, Homo sapiens
  Payload ID: 12325
  Gene Symbol: PTCD2
  Gene Name: pentatricopeptide repeat domain 2
  ENSP ID: ENSP00000426295
MDMLFIKGKYKSALQVLIEMKNQDVKFTKDTYVLAFAICYKLNSPESFKICTTLREEALLKGEILSRRASCFAVALALNQNEMAKAVSIFSQIMNPESIACINLNIIIHIQSNMLENLIKTLKNAAEGNLSKFVKRHVFSEEVLAKVREKVKDVPALVAKFDEIYGTLHITGQVTTDSLDAVLCHTPRDRKSHTLLLNKRMVS

SEQ ID NO: 61727 - protein, 279 aa, Homo sapiens
  Payload ID: 12325
  Gene Symbol: PTCD2
  Gene Name: pentatricopeptide repeat domain 2
  Uniprot ID: Q8WV60
  ENSP ID: ENSP00000427349
MVRDSMAAAFRPSNRVLLQALQILVYPGVGGSGSVSCRCPLGAKRYLLTDNVVKLKEFQQKKVAVACNLSGTKGALQVLIEMKNQDVKFTKDTYVLAFAICYKLNSPESFKICTTLREEALLKGEILSRRASCFAVALALNQNEMAKAVSIFSQIMNPESIACINLNIIIHIQSNMLENLIKTLKNAAEGNLSKFVKRHVFSEEVLAKVREKVKDVPALVAKFDEIYGTLHITGQVTTDSLDAVLCHTPRDRKSHTLLLNKRMVSRRTFQPLSQSLLAE

SEQ ID NO: 61728 - protein, 161 aa, Homo sapiens
  Payload ID: 12325
  Gene Symbol: PTCD2
  Gene Name: pentatricopeptide repeat domain 2
  ENSP ID: ENSP00000427524
MVRDSMAAAFRPSNRVLLQALQILVYPGVGGSGSVSCRCPLGAKRYLLTDNVVKLKEFQQKKVAVACNLSGTKETYFRNLKKKLTQNKLILKGELITLLHLCESRDHVELAKNVIYRYHAENKNFTLGEYKFGPLFVRLCYELDLEESAVELMKDQVLCKY

SEQ ID NO: 61729 - protein, 93 aa, Homo sapiens
  Payload ID: 12325
  Gene Symbol: PTCD2
  Gene Name: pentatricopeptide repeat domain 2
  ENSP ID: ENSP00000429665
MVRDSMAAAFRPSNRVLLQALQILVYPGVGGSGSVSCRCPLGAKRYLLTDNVVKLKEFQQKKVAVACNLSGTKGTMQRTKISLWGSINLDRFL

SEQ ID NO: 61730 - protein, 198 aa, Homo sapiens
  Payload ID: 12325
  Gene Symbol: PTCD2
  Gene Name: pentatricopeptide repeat domain 2
  ENSP ID: ENSP00000438810
MKNQDVKFTKDTYVLAFAICYKLNSPESFKICTTLREEALLKGEILSRRASCFAVALALNQNEMAKAVSIFSQIMNPESIACINLNIIIHIQSNMLENLIKTLKNAAEGNLSKFVKRHVFSEEVLAKVREKVKDVPALVAKFDEIYGTLHITGQVTTDSLDAVLCHTPRDRKSHTLLLNKRMVSRRTFQPLSQSLLAE

SEQ ID NO: 61731 - protein, 216 aa, Homo sapiens
  Payload ID: 12325
  Gene Symbol: PTCD2
  Gene Name: pentatricopeptide repeat domain 2
  Uniprot ID: Q8WV60
  ENSP ID: ENSP00000444772
MWNWLKMSFTGALQVLIEMKNQDVKFTKDTYVLAFAICYKLNSPESFKICTTLREEALLKGEILSRRASCFAVALALNQNEMAKAVSIFSQIMNPESIACINLNIIIHIQSNMLENLIKTLKNAAEGNLSKFVKRHVFSEEVLAKVREKVKDVPALVAKFDEIYGTLHITGQVTTDSLDAVLCHTPRDRKSHTLLLNKRMVSRRTFQPLSQSLLAE

SEQ ID NO: 61732 - protein, 689 aa, Homo sapiens
  Payload ID: 12326
  Gene Symbol: PTCD3
  Gene Name: pentatricopeptide repeat domain 3
  Uniprot ID: Q96EY7
  ENSP ID: ENSP00000254630
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPASSLESRSFLLAKKSGENVAKFIINSYPKYFQKDIAEPHIPCLMPEYFEPQIKDISEAALKERIELRKVKASVDMFDQLLQAGTTVSLETTNSLLDLLCYYGDQEPSTDYHFQQTGQSEALEEENDETSRRKAGHQFGVTWRAKNNAERIFSLMPEKNEHSYCTMIRGMVKHRAYEQALNLYTELLNNRLHADVYTFNALIEATVCAINEKFEEKWSKILELLRHMVAQKVKPNLQTFNTILKCLRRFHVFARSPALQVLREMKAIGIEPSLATYHHIIRLFDQPGDPLKRSSFIIYDIMNELMGKRFSPKDPDDDKFFQSAMSICSSLRDLELAYQVHGLLKTGDNWKFIGPDQHRNFYYSKFFDLICLMEQIDVTLKWYEDLIPSAYFPHSQTMIHLLQALDVANRLEVIPKIWKDSKEYGHTFRSDLREEILMLMARDKHPPELQVAFADCAADIKSAYESQPIRQTAQDWPATSLNCIAILFLRAGRTQEAWKMLGLFRKHNKIPRSELLNELMDSAKVSNSPSQAIEVVELASAFSLPICEGLTQRVMSDFAINQEQKEALSNLTALTSDSDTDSSSDSDSDTSEGK

SEQ ID NO: 61733 - protein, 187 aa, Homo sapiens
  Payload ID: 12326
  Gene Symbol: PTCD3
  Gene Name: pentatricopeptide repeat domain 3
  ENSP ID: ENSP00000386922
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPASSLESRSFLLAKKSGENVAKFIINSYPKYFQKDIAEPHIPEPLCLLKQQIVSWIYCVTMVTRSPQLITIFNKLDSQKHWKRKMMRHLGG

SEQ ID NO: 61734 - protein, 78 aa, Homo sapiens
  Payload ID: 12326
  Gene Symbol: PTCD3
  Gene Name: pentatricopeptide repeat domain 3
  ENSP ID: ENSP00000386963
MAVVSAVRWLGLRSRLGQPLTGRRAGLCEQARSCSSPQERETTPSDTAETFVLPFNASPPFPDFILVVQPSQRLKELM

SEQ ID NO: 61735 - protein, 69 aa, Homo sapiens
  Payload ID: 12326
  Gene Symbol: PTCD3
  Gene Name: pentatricopeptide repeat domain 3
  ENSP ID: ENSP00000394441
MAVVSAVRWLGLRSRLGQPLTGRRAGLCEQARSCRFYSGSATLSKVEGTDVTGIEEVVIPKKKTCDLVT

SEQ ID NO: 61736 - protein, 69 aa, Homo sapiens; identical to SEQ ID NO: 61735
  Payload ID: 12326
  Gene Symbol: PTCD3
  Gene Name: pentatricopeptide repeat domain 3
  ENSP ID: ENSP00000487135

SEQ ID NO: 61737 - protein, 381 aa, Homo sapiens
  Payload ID: 12327
  Gene Symbol: PTX3
  Gene Name: pentraxin 3, long
  Uniprot ID: P26022
  ENSP ID: ENSP00000295927
MHLLAILFCALWSAVLAENSDDYDLMYVNLDNEIDNGLHPTEDPTPCACGQEHSEWDKLFIMLENSQMRERMLLQATDDVLRGELQRLREELGRLAESLARPCAPGAPAEARLTSALDELLQATRDAGRRLARMEGAEAQRPEEAGRALAAVLEELRQTRADLHAVQGWAARSWLPAGCETAILFPMRSKKIFGSVHPVRPMRLESFSACIWVKATDVLNKTILFSYGTKRNPYEIQLYLSYQSIVFVVGGEENKLVAEAMVSLGRWTHLCGTWNSEEGLTSLWVNGELAATTVEMATGHIVPEGGILQIGQEKNGCCVGGGFDETLAFSGRLTGFNIWDSVLSNEEIRETGGAESCHIRGNIVGWGVTEIQPHGGAQYVS

SEQ ID NO: 61738 - protein, 473 aa, Homo sapiens
  Payload ID: 12328
  Gene Symbol: PTX4
  Gene Name: pentraxin 4, long
  Uniprot ID: Q96A99
  ENSP ID: ENSP00000293922
MGSGNWEVTGPPCGSRCERPPGLPRGVHGQFRSAVGLSGLRWFRRFQEVTWTHLQNIASNYNVSYNVDVRFRSLAEESQAVAQAVNRSQASVQGELAQLKAWVRKLQRRGRKVDTRLRALDLTLGERSQQRARERKAHKAQRDALQDSLARLEGLVHSQGARLAALEGRLPVAHPGTAALGPALVPTPTQPEELGPTSLKLQRDRQELRAASEHRGPPQDSSAPLQGRREPPASGSHRVLSGTAPKDPRQQAWSPQVPGEICGVGPTLVFPNASTRNVVFLSPGFVTALRALSFCSWVRTASGRLGTLLSYATEDNDNKLVLHGRDSLLPGSIHFVIGDPAFRELPLQLLLDGQWHHICVIWTSTQGRYWLHVDRRLVATGSRFREGYEIPPGGSLVLGQEQDSVGGGFDSSEAFVGSMSGLAIWDRALVPGEVANLAIGKEFPTGAILTLANAALAGGFVQGANCTCLERCP

SEQ ID NO: 61739 - protein, 478 aa, Homo sapiens
  Payload ID: 12328
  Gene Symbol: PTX4
  Gene Name: pentraxin 4, long
  Uniprot ID: Q96A99
  ENSP ID: ENSP00000445277
MGCSWRKTLSFFLVFVPIYLHGASSQEAAPVGPRKPFFERLRRLEEQFRRFQEVTWTHLQNIASNYNVSYNVDVRFRSLAEESQAVAQAVNRSQASVQGELAQLKAWVRKLQRRGRKVDTRLRALDLTLGERSQQRARERKAHKAQRDALQDSLARLEGLVHSQGARLAALEGRLPVAHPGTAALGPALVPTPTQPEELGPTSLKLQRDRQELRAASEHRGPPQDSSAPLQGRREPPASGSHRVLSGTAPKDPRQQAWSPQVPGEICGVGPTLVFPNASTRNVVFLSPGFVTALRALSFCSWVRTASGRLGTLLSYATEDNDNKLVLHGRDSLLPGSIHFVIGDPAFRELPLQLLLDGQWHHICVIWTSTQGRYWLHVDRRLVATGSRFREGYEIPPGGSLVLGQEQDSVGGGFDSSEAFVGSMSGLAIWDRALVPGEVANLAIGKEFPTGAILTLANAALAGGFVQGANCTCLERCP

SEQ ID NO: 61740 - protein, 192 aa, Homo sapiens
  Payload ID: 12328
  Gene Symbol: PTX4
  Gene Name: pentraxin 4, long
  ENSP ID: ENSP00000456816
MGCSWRKTLSFFLVFVPIYLHGASSQEAAPVGPRKPFFERLRRLEEQFRRFQEVTWTHLQNIASNYNVSYNVDVRFRSLAEESQAVAQAVNRSQASVQGELAQLKAWVRKLQRRGRKFAAWAPPSFSQTPPPGTWSSSALVSSLPCEPCPSAAGSARPPAAWAPSCPTPPRTMTTSWCCTAETPCCPDPSTS

SEQ ID NO: 61741 - protein, 388 aa, Homo sapiens
  Payload ID: 12329
  Gene Symbol: PGA3
  Gene Name: pepsinogen 3, group I (pepsinogen A)
  Uniprot ID: P0DJD8
  ENSP ID: ENSP00000322192
MKWLLLLGLVALSECIMYKVPLIRKKSLRRTLSERGLLKDFLKKHNLNPARKYFPQWKAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 61742 - protein, 128 aa, Homo sapiens
  Payload ID: 12329
  Gene Symbol: PGA3
  Gene Name: pepsinogen 3, group I (pepsinogen A)
  ENSP ID: ENSP00000439846
MNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 61743 - protein, 234 aa, Homo sapiens
  Payload ID: 12329
  Gene Symbol: PGA3
  Gene Name: pepsinogen 3, group I (pepsinogen A)
  ENSP ID: ENSP00000440177
MVSGNNSDSAHCIGTGLRGKETTLVTPQDSPRKCPIKGSPEEATADGHTNGRTKKFMSSPLTFHSDDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 61744 - protein, 184 aa, Homo sapiens
  Payload ID: 12329
  Gene Symbol: PGA3
  Gene Name: pepsinogen 3, group I (pepsinogen A)
  ENSP ID: ENSP00000442525
MEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVD

SEQ ID NO: 61745 - protein, 265 aa, Homo sapiens
  Payload ID: 12329
  Gene Symbol: PGA3
  Gene Name: pepsinogen 3, group I (pepsinogen A)
  ENSP ID: ENSP00000443732
MEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYIL

SEQ ID NO: 61746 - protein, 388 aa, Homo sapiens
  Payload ID: 12330
  Gene Symbol: PGA4
  Gene Name: pepsinogen 4, group I (pepsinogen A)
  Uniprot ID: P0DJD7
  ENSP ID: ENSP00000367391
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 61747 - protein, 234 aa, Homo sapiens; identical to SEQ ID NO: 61743
  Payload ID: 12330
  Gene Symbol: PGA4
  Gene Name: pepsinogen 4, group I (pepsinogen A)
  ENSP ID: ENSP00000442757

SEQ ID NO: 61748 - protein, 128 aa, Homo sapiens; identical to SEQ ID NO: 61742
  Payload ID: 12330
  Gene Symbol: PGA4
  Gene Name: pepsinogen 4, group I (pepsinogen A)
  ENSP ID: ENSP00000443623

SEQ ID NO: 61749 - protein, 388 aa, Homo sapiens
  Payload ID: 12331
  Gene Symbol: PGA5
  Gene Name: pepsinogen 5, group I (pepsinogen A)
  Uniprot ID: P0DJD9
  ENSP ID: ENSP00000309542
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDKSGSVVIFGGIDSSYYTGSLNWVPVTVEGYWQITVDSITMNGETIACAEGCQAIVDTGTSLLTGPTSPIANIQSDIGASENSDGDMVVSCSAISSLPDIVFTINGVQYPVPPSAYILQSEGSCISGFQGMNVPTESGELWILGDVFIRQYFTVFDRANNQVGLAPVA

SEQ ID NO: 61750 - protein, 234 aa, Homo sapiens
  Payload ID: 12331
  Gene Symbol: PGA5
  Gene Name: pepsinogen 5, group I (pepsinogen A)
  ENSP ID: ENSP00000408739
MVSGNNSDGAHCMGPGLRGKETTLVTPQDSPGKCPINGRSEEATADGHTNGRTKKFMSSPLTFHSDDKSGSVVIFGGIDSSYYTGSLNWVPVTVEGYWQITVDSITMNGETIACAEGCQAIVDTGTSLLTGPTSPIANIQSDIGASENSDGDMVVSCSAISSLPDIVFTINGVQYPVPPSAYILQSEGSCISGFQGMNVPTESGELWILGDVFIRQYFTVFDRANNQVGLAPVA

SEQ ID NO: 61751 - protein, 128 aa, Homo sapiens
  Payload ID: 12331
  Gene Symbol: PGA5
  Gene Name: pepsinogen 5, group I (pepsinogen A)
  ENSP ID: ENSP00000441981
MNGETIACAEGCQAIVDTGTSLLTGPTSPIANIQSDIGASENSDGDMVVSCSAISSLPDIVFTINGVQYPVPPSAYILQSEGSCISGFQGMNVPTESGELWILGDVFIRQYFTVFDRANNQVGLAPVA

SEQ ID NO: 61752 - protein, 525 aa, Homo sapiens
  Payload ID: 12332
  Gene Symbol: PMPCA
  Gene Name: peptidase (mitochondrial processing) alpha
  Uniprot ID: Q10713
  ENSP ID: ENSP00000360782
MAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRYEAKYLSGIAHFLEKLAFSSTARFDSKDEILLTLEKHGGICDCQTSRDTTMYAVSADSKGLDTVVALLADVVLQPRLTDEEVEMTRMAVQFELEDLNLRPDPEPLLTEMIHEAAYRENTVGLHRFCPTENVAKINREVLHSYLRNYYTPDRMVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIRNVKPEDVKRVASKMLRGKPAVAALGDLTDLPTYEHIQTALSSKDGRLPRTYRLFR

SEQ ID NO: 61753 - protein, 271 aa, Homo sapiens
  Payload ID: 12332
  Gene Symbol: PMPCA
  Gene Name: peptidase (mitochondrial processing) alpha
  ENSP ID: ENSP00000408393
YTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIREYRRGSEGLPQASARLRGGRLALPQAVVGLWYVHHTQNLGPSPVVLSRGGQGQGRGVADLVSLPGPTMHLLPPWQVTPPSAPLGGAVTTAQSC

SEQ ID NO: 61754 - protein, 394 aa, Homo sapiens
  Payload ID: 12332
  Gene Symbol: PMPCA
  Gene Name: peptidase (mitochondrial processing) alpha
  Uniprot ID: Q10713
  ENSP ID: ENSP00000416702
MKRNTLVELLTFWKNWHFRLLLDLTAKMKFCLRWKSMGVSVTARHQDEEVEMTRMAVQFELEDLNLRPDPEPLLTEMIHEAAYRENTVGLHRFCPTENVAKINREVLHSYLRNYYTPDRMVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIRNVKPEDVKRVASKMLRGKPAVAALGDLTDLPTYEHIQTALSSKDGRLPRTYRLFR

SEQ ID NO: 61755 - protein, 489 aa, Homo sapiens
  Payload ID: 12333
  Gene Symbol: PMPCB
  Gene Name: peptidase (mitochondrial processing) beta
  Uniprot ID: O75439
  ENSP ID: ENSP00000249269
MAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENIKSISRKDLVDYITTHYKGPRIVLAAAGGVSHDELLDLAKFHFGDSLCTHKGEIPALPPCKFTGSEIRVRDDKMPLAHLAIAVEAVGWAHPDTICLMVANTLIGNWDRSFGGGMNLSSKLAQLTCHGNLCHSFQSFNTSYTDTGLWGLYMVCESSTVADMLHVVQKEWMRLCTSVTESEVARARNLLKTNMLLQLDGSTPICEDIGRQMLCYNRRIPIPELEARIDAVNAETIREVCTKYIYNRSPAIAAVGPIKQLPDFKQIRSNMCWLRD

SEQ ID NO: 61756 - protein, 122 aa, Homo sapiens
  Payload ID: 12333
  Gene Symbol: PMPCB
  Gene Name: peptidase (mitochondrial processing) beta
  ENSP ID: ENSP00000388934
MAAAAARVVLSSAARRRLWGFSESLLIRGAAGRVSFPPGRSCPRDLARPGAAHLRVGATDPNSGSGRASSTRTRRAPGGLGLLNWPGVTGLWPPARRPASDVWDDPGFRLLPPATEECMFDH

SEQ ID NO: 61757 - protein, 490 aa, Homo sapiens
  Payload ID: 12333
  Gene Symbol: PMPCB
  Gene Name: peptidase (mitochondrial processing) beta
  ENSP ID: ENSP00000390035
MAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENIKSISRKDLVDYITTHYKGPRIVLAAAGGVSHDELLDLAKFHFGDSLCTHKGEIPALPPCKFTGSEIRVRDDKMPLAHLAIAVEAVGWAHPDTICLMVANTLIGNWDRSFGGGMNLSSKLAQLTCHGNLCHSFQSFNTSYTDTGLWGLYMVCESSTVADMLHVVQKEWMRLCTSVTESEVARARNLLKTNMLLQLDGSTPICEDIGRQMLCYNRRIPIPELEARIDAVNAETIREVCTKYIYNRSPAIAAVGKPGFFSSMQKVGQVLLINSSF

SEQ ID NO: 61758 - protein, 202 aa, Homo sapiens
  Payload ID: 12333
  Gene Symbol: PMPCB
  Gene Name: peptidase (mitochondrial processing) beta
  ENSP ID: ENSP00000397884
MAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVYYAKAFSKDLPRAYQNTALGRTILGPTENIKSISRKDLVDYITTHYKGPRIVLAAAGDSCEG

SEQ ID NO: 61759 - protein, 122 aa, Homo sapiens
  Payload ID: 12333
  Gene Symbol: PMPCB
  Gene Name: peptidase (mitochondrial processing) beta
  ENSP ID: ENSP00000402859
MAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKARHQEEIPVRSGT

SEQ ID NO: 61760 - protein, 119 aa, Homo sapiens
  Payload ID: 12333
  Gene Symbol: PMPCB
  Gene Name: peptidase (mitochondrial processing) beta
  ENSP ID: ENSP00000408682
MAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKAKEIPVRSGT

SEQ ID NO: 61761 - protein, 493 aa, Homo sapiens
  Payload ID: 12334
  Gene Symbol: PEPD
  Gene Name: peptidase D
  Uniprot ID: P12955
  ENSP ID: ENSP00000244137
MAAATGPSFWLGNETLKVPLALFALNRQRLCERLRKNPAVQAGSIVVLQGGEETQRYCTDTGVLFRQESFFHWAFGVTEPGCYGVIDVDTGKSTLFVPRLPASHATWMGKIHSKEHFKEKYAVDDVQYVDEIASVLTSQKPSVLLTLRGVNTDSGSVCREASFDGISKFEVNNTILHPEIVECRVFKTDMELEVLRYTNKISSEAHREVMKAVKVGMKEYELESLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGVWWPDMHRLADRIHLEELAHMGILSGSVDAMVQAHLGAVFMPHGLGHFLGIDVHDVGGYPEGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 61762 - protein, 452 aa, Homo sapiens
  Payload ID: 12334
  Gene Symbol: PEPD
  Gene Name: peptidase D
  Uniprot ID: P12955
  ENSP ID: ENSP00000380226
MAAATGPSFWLGNETLKVPLALFALNRQRLCERLRKNPAVQAGSIVVLQGGEETQRYCTDTGVLFRQESFFHWAFGVTEPGCYGVIDVDTGKSTLFVPRLPASHATWMGKIHSKEHFKEKYAVDDVQYVDEIASVLTSQKPSVLLTLRGVNTDSGSVCREASFDGISKFEVNNTILHPEIVECLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGVWWPDMHRLADRIHLEELAHMGILSGSVDAMVQAHLGAVFMPHGLGHFLGIDVHDVGGYPEGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 61763 - protein, 429 aa, Homo sapiens
  Payload ID: 12334
  Gene Symbol: PEPD
  Gene Name: peptidase D
  Uniprot ID: P12955
  ENSP ID: ENSP00000391890
MAAATGPSFWLGNETLKVPLALFALNRQRLCERLRKNPAVQAGSIVVLQGGEETQRYCTDTGVLFRQIASVLTSQKPSVLLTLRGVNTDSGSVCREASFDGISKFEVNNTILHPEIVECRVFKTDMELEVLRYTNKISSEAHREVMKAVKVGMKEYELESLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGVWWPDMHRLADRIHLEELAHMGILSGSVDAMVQAHLGAVFMPHGLGHFLGIDVHDVGGYPEGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 61764 - protein, 194 aa, Homo sapiens
  Payload ID: 12334
  Gene Symbol: PEPD
  Gene Name: peptidase D
  ENSP ID: ENSP00000468516
  MOD_RES (1)..(1): Any amino acid
XVNNTILHPEIVECRVFKTDMELEVLRYTNKISSEAHREVMKAVKVGMKEYELESLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGARTGRTVFSVGTMSTPPAGRNGVWWPDMHRLADRIHLEEL

SEQ ID NO: 61765 - protein, 104 aa, Homo sapiens
  Payload ID: 12334
  Gene Symbol: PEPD
  Gene Name: peptidase D
  ENSP ID: ENSP00000476514
MELEVLRYTNKISSEAHREVMKAVKVGMKEYELESLFEHYCYSRGGMRHSSYTCICGSGENSAVLHYGHAGAPNDRTIQNGDMCLFDMGGEYYCFASDITCSFP

SEQ ID NO: 61766 - protein, 55 aa, Homo sapiens
  Payload ID: 12334
  Gene Symbol: PEPD
  Gene Name: peptidase D
  ENSP ID: ENSP00000476667
IASVLTSQKPSVLLTLRGVNTDSGSVCREASFDGISKFEVNNTILHPEIVECWEL

SEQ ID NO: 61767 - protein, 42 aa, Homo sapiens
  Payload ID: 12334
  Gene Symbol: PEPD
  Gene Name: peptidase D
  ENSP ID: ENSP00000476869
  MOD_RES (1)..(1): Any amino acid
XAFGVTEPGCYGVIDVDTGKSTLFVPRLPASHATWMGKLPAS

SEQ ID NO: 61768 - protein, 675 aa, Homo sapiens
  Payload ID: 12335
  Gene Symbol: PAMR1
  Gene Name: peptidase domain containing associated with muscle regeneration 1
  ENSP ID: ENSP00000432591
MCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEAGKSKIKASEDSLSVLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCS

SEQ ID NO: 61769 - protein, 177 aa, Homo sapiens
  Payload ID: 12335
  Gene Symbol: PAMR1
  Gene Name: peptidase domain containing associated with muscle regeneration 1
  ENSP ID: ENSP00000433024
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMPCSSSPCFHDGTCVLDKAGSYKCACLAGYTGQRCENLLEERNCSDPGGPVN

SEQ ID NO: 61770 - protein, 416 aa, Homo sapiens
  Payload ID: 12335
  Gene Symbol: PAMR1
  Gene Name: peptidase domain containing associated with muscle regeneration 1
  ENSP ID: ENSP00000478867
MLKLAPWCLSFVTTPMFLVAMRKELASRMEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 61771 - protein, 609 aa, Homo sapiens
  Payload ID: 12335
  Gene Symbol: PAMR1
  Gene Name: peptidase domain containing associated with muscle regeneration 1
  Uniprot ID: Q6UXH9
  ENSP ID: ENSP00000479260
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMPCSSSPCFHDGTCVLDKAGSYKCACLAGYTGQRCENLLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 61772 - protein, 680 aa, Homo sapiens
  Payload ID: 12335
  Gene Symbol: PAMR1
  Gene Name: peptidase domain containing associated with muscle regeneration 1
  ENSP ID: ENSP00000480961
MCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 61773 - protein, 737 aa, Homo sapiens
  Payload ID: 12335
  Gene Symbol: PAMR1
  Gene Name: peptidase domain containing associated with muscle regeneration 1
  Uniprot ID: Q6UXH9
  ENSP ID: ENSP00000482899
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEAGKSKIKASEDSLSVLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 61774 - protein, 720 aa, Homo sapiens
  Payload ID: 12335
  Gene Symbol: PAMR1
  Gene Name: peptidase domain containing associated with muscle regeneration 1
  Uniprot ID: Q6UXH9
  ENSP ID: ENSP00000483703
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 61775 - protein, 258 aa, Homo sapiens
  Payload ID: 12336
  Gene Symbol: PI15
  Gene Name: peptidase inhibitor 15
  Uniprot ID: O43692
  ENSP ID: ENSP00000260113
MIAISAVSSALLFSLLCEASTVVLLNSTDSSPPTNNFTDIEAALKAQLDSADIPKARRKRYISQNDMIAILDYHNQVRGKVFPPAANMEYMVWDENLAKSAEAWAATCIWDHGPSYLLRFLGQNLSVRTGRYRSILQLVKPWYDEVKDYAFPYPQDCNPRCPMRCFGPMCTHYTQMVWATSNRIGCAIHTCQNMNVWGSVWRRAVYLVCNYAPKGNWIGEAPYKVGVPCSSCPPSYGGSCTDNLCFPGVTSNYLYWFK

SEQ ID NO: 61776 - protein, 258 aa, Homo sapiens; identical to SEQ ID NO: 61775
  Payload ID: 12336
  Gene Symbol: PI15
  Gene Name: peptidase inhibitor 15
  Uniprot ID: O43692
  ENSP ID: ENSP00000428567

SEQ ID NO: 61777 - protein, 463 aa, Homo sapiens
  Payload ID: 12337
  Gene Symbol: PI16
  Gene Name: peptidase inhibitor 16
  Uniprot ID: Q6UXB8
  ENSP ID: ENSP00000362778
MHGSCSFLMLLLPLLLLLVATTGPVGALTDEEKRLMVELHNLYRAQVSPTASDMLHMRWDEELAAFAKAYARQCVWGHNKERGRRGENLFAITDEGMDVPLAMEEWHHEREHYNLSAATCSPGQMCGHYTQVVWAKTERIGCGSHFCEKLQGVEETNIELLVCNYEPPGNVKGKRPYQEGTPCSQCPSGYHCKNSLCEPIGSPEDAQDLPYLVTEAPSFRATEASDSRKMGTPSSLATGIPAFLVTEVSGSLATKALPAVETQAPTSLATKDPPSMATEAPPCVTTEVPSILAAHSLPSLDEEPVTFPKSTHVPIPKSADKVTDKTKVPSRSPENSLDPKMSLTGARELLPHAQEEAEAEAELPPSSEVLASVFPAQDKPGELQATLDHTGHTSSKSLPNFPNTSATANATGGRALALQSSLPGAEGPDKPSVVSGLNSGPGHVWGPLLGLLLLPPLVLAGIF

SEQ ID NO: 61778 - protein, 463 aa, Homo sapiens; identical to SEQ ID NO: 61777
  Payload ID: 12337
  Gene Symbol: PI16
  Gene Name: peptidase inhibitor 16
  Uniprot ID: Q6UXB8
  ENSP ID: ENSP00000478888

SEQ ID NO: 61779 - protein, 117 aa, Homo sapiens
  Payload ID: 12338
  Gene Symbol: PI3
  Gene Name: peptidase inhibitor 3, skin-derived
  Uniprot ID: P19957
  ENSP ID: ENSP00000243924
MRASSFLIVVVFLIAGTLVLEAAVTGVPVKGQDTVKGRVPFNGQDPVKGQVSVKGQDKVKAQEPVKGPVSTKPGSCPIILIRCAMLNPPNRCLKDTDCPGIKKCCEGSCGMACFVPQ

SEQ ID NO: 61780 - protein, 502 aa, Homo sapiens
  Payload ID: 12339
  Gene Symbol: PM20D1
  Gene Name: peptidase M20 domain containing 1
  Uniprot ID: Q6GTS8
  ENSP ID: ENSP00000356104
MAQRCVCVLALVAMLLLVFPTVSRSMGPRSGEHQRASRIPSQFSKEERVAMKEALKGAIQIPTVTFSSEKSNTTALAEFGKYIHKVFPTVVSTSFIQHEVVEEYSHLFTIQGSDPSLQPYLLMAHFDVVPAPEEGWEVPPFSGLERDGIIYGRGTLDDKNSVMALLQALELLLIRKYIPRRSFFISLGHDEESSGTGAQRISALLQSRGVQLAFIVDEGGFILDDFIPNFKKPIALIAVSEKGSMNLMLQVNMTSGHSSAPPKETSIGILAAAVSRLEQTPMPIIFGSGTVVTVLQQLANEFPFPVNIILSNPWLFEPLISRFMERNPLTNAIIRTTTALTIFKAGVKFNVIPPVAQATVNFRIHPGQTVQEVLELTKNIVADNRVQFHVLSAFDPLPVSPSDDKALGYQLLRQTVQSVFPEVNITAPVTSIGNTDSRFFTNLTTGIYRFYPIYIQPEDFKRIHGVNEKISVQAYETQVKFIFELIQNADTDQEPVSHLHKL

SEQ ID NO: 61781 - protein, 436 aa, Homo sapiens
  Payload ID: 12340
  Gene Symbol: PM20D2
  Gene Name: peptidase M20 domain containing 2
  Uniprot ID: Q8IYS1
  ENSP ID: ENSP00000275072
MRPGGERPVEGGACNGRSELELLKLRSAECIDEAAERLGALSRAIWSQPELAYEEHHAHRVLTHFFEREPPAASWAVQPHYQLPTAFRAEWEPPEARAPSATPRPLHLGFLCEYDALPGIGHACGHNLIAEVGAAAALGVRGALEGLPRPPPPVKVVVLGTPAEEDGGGKIDLIEAGAFTNLDVVFMAHPSQENAAYLPDMAEHDVTVKYYGKASHSASYPWEGLNALDAAVLAYNNLSVFRQQMKPTWRVHGIIKNGGVKPNIIPSYSELIYYFRAPSMKELQVLTKKAEDCFRAAALASGCTVEIKGGAHDYYNVLPNKSLWKAYMENGRKLGIEFISEDTMLNGPSGSTDFGNVSFVVPGIHPYFHIGSNALNHTEQYTEAAGSQEAQFYTLRTAKALAMTALDVIFKPELLEGIREDFKLKLQEEQFVNAVE

SEQ ID NO: 61782 - protein, 243 aa, Homo sapiens
  Payload ID: 12341
  Gene Symbol: PDF
  Gene Name: peptide deformylase (mitochondrial)
  Uniprot ID: Q9HBH1
  ENSP ID: ENSP00000288022
MARLWGALSLWPLWAAVPWGGAAAVGVRACSSTAAPDGVEGPALRRSYWRHLRRLVLGPPEPPFSHVCQVGDPVLRGVAAPVERAQLGGPELQRLTQRLVQVMRRRRCVGLSAPQLGVPRQVLALELPEALCRECPPRQRALRQMEPFPLRVFVNPSLRVLDSRLVTFPEGCESVAGFLACVPRFQAVQISGLDPNGEQVVWQASGWAARIIQHEMDHLQGCLFIDKMDSRTFTNVYWMKVND

SEQ ID NO: 61783 - protein, 97 aa, Homo sapiens
  Payload ID: 12342
  Gene Symbol: PYY
  Gene Name: peptide YY
  Uniprot ID: P10082
  ENSP ID: ENSP00000353198
MVFVRRPWPALTTVLLALLVCLGALVDAYPIKPEAPREDASPEELNRYYASLRHYLNLVTRQRYGKRDGPDTLLSKTFFPDGEDRPVRSRSEGPDLW

SEQ ID NO: 61784 - protein, 90 aa, Homo sapiens
  Payload ID: 12342
  Gene Symbol: PYY
  Gene Name: peptide YY
  Uniprot ID: P10082
  ENSP ID: ENSP00000467310
MVFVRRPWPALTTVLLALLVCLGALVDAYPIKPEAPREDASPEELNRYYASLRHYLNLVTRQRYGKRDGPDTLLSKTFFPDGEDRPVRSR

SEQ ID NO: 61785 - protein, 196 aa, Homo sapiens
  Payload ID: 12343
  Gene Symbol: PGLYRP1
  Gene Name: peptidoglycan recognition protein 1
  Uniprot ID: O75594
  ENSP ID: ENSP00000008938
MSRRSMLLAWALPSLLRLGAAQETEDPACCSPIVPRNEWKALASECAQHLSLPLRYVVVSHTAGSSCNTPASCQQQARNVQHYHMKTLGWCDVGYNFLIGEDGLVYEGRGWNFTGAHSGHLWNPMSIGISFMGNYMDRVPTPQAIRAAQGLLACGVAQGALRSNYVLKGHRDVQRTLSPGNQLYHLIQNWPHYRSP

SEQ ID NO: 61786 - protein, 634 aa, Homo sapiens
  Payload ID: 12344
  Gene Symbol: PGLYRP2
  Gene Name: peptidoglycan recognition protein 2
  Uniprot ID: Q96PD5
  ENSP ID: ENSP00000292609
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYSFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTAVSLRSLHYTARRPSVYTSSTRPLPPACNSCARTASARPPTSRRHVYSGNLGPAFAGHSAGNIPDPVTSAYAASAQPQTQPACPFPSS

SEQ ID NO: 61787 - protein, 576 aa, Homo sapiens
  Payload ID: 12344
  Gene Symbol: PGLYRP2
  Gene Name: peptidoglycan recognition protein 2
  Uniprot ID: Q96PD5
  ENSP ID: ENSP00000345968
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYSFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTATVKPRPARSVSKRSRREPPPRTLPATDLQ

SEQ ID NO: 61788 - protein, 105 aa, Homo sapiens
  Payload ID: 12344
  Gene Symbol: PGLYRP2
  Gene Name: peptidoglycan recognition protein 2
  ENSP ID: ENSP00000470112
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREG

SEQ ID NO: 61789 - protein, 181 aa, Homo sapiens
  Payload ID: 12344
  Gene Symbol: PGLYRP2
  Gene Name: peptidoglycan recognition protein 2
  ENSP ID: ENSP00000472856
MGTRRRGRTFHCQPSTAEVLCRGQPEIPLGSWNPATMAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSM

SEQ ID NO: 61790 - protein, 341 aa, Homo sapiens
  Payload ID: 12345
  Gene Symbol: PGLYRP3
  Gene Name: peptidoglycan recognition protein 3
  Uniprot ID: Q96LB9
  ENSP ID: ENSP00000290722
MGTLPWLLAFFILGLQAWDTPTIVSRKEWGARPLACRALLTLPVAYIITDQLPGMQCQQQSVCSQMLRGLQSHSVYTIGWCDVAYNFLVGDDGRVYEGVGWNIQGLHTQGYNNISLGIAFFGNKIGSSPSPAALSAAEGLISYAIQKGHLSPRYIQPLLLKEETCLDPQHPVMPRKVCPNIIKRSAWEARETHCPKMNLPAKYVIIIHTAGTSCTVSTDCQTVVRNIQSFHMDTRNFCDIGYHFLVGQDGGVYEGVGWHIQGSHTYGFNDIALGIAFIGYFVEKPPNAAALEAAQDLIQCAVVEGYLTPNYLLMGHSDVVNILSPGQALYNIISTWPHFKH

SEQ ID NO: 61791 - protein, 373 aa, Homo sapiens
  Payload ID: 12346
  Gene Symbol: PGLYRP4
  Gene Name: peptidoglycan recognition protein 4
  Uniprot ID: Q96LB8
  ENSP ID: ENSP00000352672
MLPWLLVFSALGIQAWGDSSWNKTQAKQVSEGLQYLFENISQLTEKGLPTDVSTTVSRKAWGAEAVGCSIQLTTPVNVLVIHHVPGLECHDQTVCSQRLRELQAHHVHNNSGCDVAYNFLVGDDGRVYEGVGWNIQGVHTQGYNNISLGFAFFGTKKGHSPSPAALSAMENLITYAVQKGHLSSSYVQPLLGKGENCLAPRQKTSLKKACPGVVPRSVWGARETHCPRMTLPAKYGIIIHTAGRTCNISDECRLLVRDIQSFYIDRLKSCDIGYNFLVGQDGAIYEGVGWNVQGSSTPGYDDIALGITFMGTFTGIPPNAAALEAAQDLIQCAMVKGYLTPNYLLVGHSDVARTLSPGQALYNIISTWPHFKH

SEQ ID NO: 61792 - protein, 369 aa, Homo sapiens
  Payload ID: 12346
  Gene Symbol: PGLYRP4
  Gene Name: peptidoglycan recognition protein 4
  Uniprot ID: Q96LB8
  ENSP ID: ENSP00000357728
MLPWLLVFSALGIQAWGDSSWNKTQAKQVSEGLQYLFENISQLTEKDVSTTVSRKAWGAEAVGCSIQLTTPVNVLVIHHVPGLECHDQTVCSQRLRELQAHHVHNNSGCDVAYNFLVGDDGRVYEGVGWNIQGVHTQGYNNISLGFAFFGTKKGHSPSPAALSAMENLITYAVQKGHLSSSYVQPLLGKGENCLAPRQKTSLKKACPGVVPRSVWGARETHCPRMTLPAKYGIIIHTAGRTCNISDECRLLVRDIQSFYIDRLKSCDIGYNFLVGQDGAIYEGVGWNVQGSSTPGYDDIALGITFMGTFTGIPPNAAALEAAQDLIQCAMVKGYLTPNYLLVGHSDVARTLSPGQALYNIISTWPHFKH

SEQ ID NO: 61793 - protein, 663 aa, Homo sapiens
  Payload ID: 12347
  Gene Symbol: PADI1
  Gene Name: peptidyl arginine deiminase, type I
  Uniprot ID: Q9ULC6
  ENSP ID: ENSP00000364620
MAPKRVVQLSLKMPTHAVCVVGVEAHVDIHSDVPKGANSFRVSGSSGVEVFMVYNRTRVKEPIGKARWPLDTDADMVVSVGTASKELKDFKVRVSYFGEQEDQALGRSVLYLTGVDISLEVDTGRTGKVKRSQGDKKTWRWGPEGYGAILLVNCDRDNHRSAEPDLTHSWLMSLADLQDMSPMLLSCNGPDKLFDSHKLVLNVPFSDSKRVRVFCARGGNSLSDYKQVLGPQCLSYEVERQPGEQEIKFYVEGLTFPDADFLGLVSLSVSLVDPGTLPEVTLFTDTVGFRMAPWIMTPNTQPPEELYVCRVMDTHGSNEKFLEDMSYLTLKANCKLTICPQVENRNDRWIQDEMEFGYIEAPHKSFPVVFDSPRNRGLKDFPYKRILGPDFGYVTREIPLPGPSSLDSFGNLDVSPPVTVGGTEYPLGRILIGSSFPKSGGRQMARAVRNFLKAQQVQAPVELYSDWLSVGHVDEFLTFVPTSDQKGFRLLLASPSACLKLFQEKKEEGYGEAAQFDGLKHQAKRSINEMLADRHLQRDNLHAQKCIDWNRNVLKRELGLAESDIVDIPQLFFLKNFYAEAFFPDMVNMVVLGKYLGIPKPYGPIINGRCCLEEKVQSLLEPLGLHCIFIDDYLSYHELQGEIHCGTNVRRKPFPFKWWNMVP

SEQ ID NO: 61794 - protein, 663 aa, Homo sapiens; identical to SEQ ID NO: 61793
  Payload ID: 12347
  Gene Symbol: PADI1
  Gene Name: peptidyl arginine deiminase, type I
  Uniprot ID: Q9ULC6
  ENSP ID: ENSP00000485803

SEQ ID NO: 61795 - protein, 437 aa, Homo sapiens
  Payload ID: 12348
  Gene Symbol: PADI2
  Gene Name: peptidyl arginine deiminase, type II
  Uniprot ID: Q9Y2J8
  ENSP ID: ENSP00000364630
MLRERTVRLQYGSRVEAVYVLGTYLWTDVYSAAPAGAQTFSLKHSEHVWVEVVRDGEAEEVATNGKQRWLLSPSTTLRVTMSQASTEASSDKVTVNYYDEEGSIPIDQAGLFLTAIEISLDVDADRDGVVEKNNPKKASWTWGPEGQGAILLVNCDRETPWLPKEDCRDEKVYSKEDLKDMSQMILRTKGPDRLPAGYEIVLYISMSDSDKVGVFYVENPFFGQRYIHILGRRKLYHVVKYTGGSAELLFFVEGLCFPDEGFSGLVSIHVSLLEYMAQDIPLTPIFTDTVIFRIAPWIMTPNILPPVSVFVCCMKDNYLFLKEVKNLVEKTNCELKVCFQYLNRGDRWIQDEIEFGYIEAPHKGFPVVLDSPRDGNLKDFPVKELLGPDFGYVTREPLFESVTSLDSFGNLEVSPPVTVNGKTYPLGRILIGSSFPL

SEQ ID NO: 61796 - protein, 665 aa, Homo sapiens
  Payload ID: 12348
  Gene Symbol: PADI2
  Gene Name: peptidyl arginine deiminase, type II
  Uniprot ID: Q9Y2J8
  ENSP ID: ENSP00000364635
MLRERTVRLQYGSRVEAVYVLGTYLWTDVYSAAPAGAQTFSLKHSEHVWVEVVRDGEAEEVATNGKQRWLLSPSTTLRVTMSQASTEASSDKVTVNYYDEEGSIPIDQAGLFLTAIEISLDVDADRDGVVEKNNPKKASWTWGPEGQGAILLVNCDRETPWLPKEDCRDEKVYSKEDLKDMSQMILRTKGPDRLPAGYEIVLYISMSDSDKVGVFYVENPFFGQRYIHILGRRKLYHVVKYTGGSAELLFFVEGLCFPDEGFSGLVSIHVSLLEYMAQDIPLTPIFTDTVIFRIAPWIMTPNILPPVSVFVCCMKDNYLFLKEVKNLVEKTNCELKVCFQYLNRGDRWIQDEIEFGYIEAPHKGFPVVLDSPRDGNLKDFPVKELLGPDFGYVTREPLFESVTSLDSFGNLEVSPPVTVNGKTYPLGRILIGSSFPLSGGRRMTKVVRDFLKAQQVQAPVELYSDWLTVGHVDEFMSFVPIPGTKKFLLLMASTSACYKLFREKQKDGHGEAIMFKGLGGMSSKRITINKILSNESLVQENLYFQRCLDWNRDILKKELGLTEQDIIDLPALFKMDEDHRARAFFPNMVNMIVLDKDLGIPKPFGPQVEEECCLEMHVRGLLEPLGLECTFIDDISAYHKFLGEVHCGTNVRRKPFTFKWWHMVP

SEQ ID NO: 61797 - protein, 664 aa, Homo sapiens
  Payload ID: 12349
  Gene Symbol: PADI3
  Gene Name: peptidyl arginine deiminase, type III
  Uniprot ID: Q9ULW8
  ENSP ID: ENSP00000364609
MSLQRIVRVSLEHPTSAVCVAGVETLVDIYGSVPEGTEMFEVYGTPGVDIYISPNMERGRERADTRRWRFDATLEIIVVMNSPSNDLNDSHVQISYHSSHEPLPLAYAVLYLTCVDISLDCDLNCEGRQDRNFVDKRQWVWGPSGYGGILLVNCDRDDPSCDVQDNCDQHVHCLQDLEDMSVMVLRTQGPAALFDDHKLVLHTSSYDAKRAQVFHICGPEDVCEAYRHVLGQDKVSYEVPRLHGDEERFFVEGLSFPDAGFTGLISFHVTLLDDSNEDFSASPIFTDTVVFRVAPWIMTPSTLPPLEVYVCRVRNNTCFVDAVAELARKAGCKLTICPQAENRNDRWIQDEMELGYVQAPHKTLPVVFDSPRNGELQDFPYKRILGPDFGYVTREPRDRSVSGLDSFGNLEVSPPVVANGKEYPLGRILIGGNLPGSSGRRVTQVVRDFLHAQKVQPPVELFVDWLAVGHVDEFLSFVPAPDGKGFRMLLASPGACFKLFQEKQKCGHGRALLFQGVVDDEQVKTISINQVLSNKDLINYNKFVQSCIDWNREVLKRELGLAECDIIDIPQLFKTERKKATAFFPDLVNMLVLGKHLGIPKPFGPIINGCCCLEEKVRSLLEPLGLHCTFIDDFTPYHMLHGEVHCGTNVCRKPFSFKWWNMVP

SEQ ID NO: 61798 - protein, 664 aa, Homo sapiens; identical to SEQ ID NO: 61797
  Payload ID: 12349
  Gene Symbol: PADI3
  Gene Name: peptidyl arginine deiminase, type III
  Uniprot ID: Q9ULW8
  ENSP ID: ENSP00000486702

SEQ ID NO: 61799 - protein, 663 aa, Homo sapiens
  Payload ID: 12350
  Gene Symbol: PADI4
  Gene Name: peptidyl arginine deiminase, type IV
  Uniprot ID: Q9UM07
  ENSP ID: ENSP00000364597
MAQGTLIRVTPEQPTHAVCVLGTLTQLDICSSAPEDCTSFSINASPGVVVDIAHGPPAKKKSTGSSTWPLDPGVEVTLTMKVASGSTGDQKVQISYYGPKTPPVKALLYLTGVEISLCADITRTGKVKPTRAVKDQRTWTWGPCGQGAILLVNCDRDNLESSAMDCEDDEVLDSEDLQDMSLMTLSTKTPKDFFTNHTLVLHVARSEMDKVRVFQATRGKLSSKCSVVLGPKWPSHYLMVPGGKHNMDFYVEALAFPDTDFPGLITLTISLLDTSNLELPEAVVFQDSVVFRVAPWIMTPNTQPPQEVYACSIFENEDFLKSVTTLAMKAKCKLTICPEEENMDDQWMQDEMEIGYIQAPHKTLPVVFDSPRNRGLKEFPIKRVMGPDFGYVTRGPQTGGISGLDSFGNLEVSPPVTVRGKEYPLGRILFGDSCYPSNDSRQMHQALQDFLSAQQVQAPVKLYSDWLSVGHVDEFLSFVPAPDRKGFRLLLASPRSCYKLFQEQQNEGHGEALLFEGIKKKKQQKIKNILSNKTLREHNSFVERCIDWNRELLKRELGLAESDIIDIPQLFKLKEFSKAEAFFPNMVNMLVLGKHLGIPKPFGPVINGRCCLEEKVCSLLEPLGLQCTFINDFFTYHIRHGEVHCGTNVRRKPFSFKWWNMVP

SEQ ID NO: 61800 - protein, 127 aa, Homo sapiens
  Payload ID: 12350
  Gene Symbol: PADI4
  Gene Name: peptidyl arginine deiminase, type IV
  ENSP ID: ENSP00000364602
MAQGTLIRVTPEQPTHAVCVLGTLTQLDICSSAPEDCTSFSINASPGVVVDIAHGPPAKKKSTGSSTWPLDPGVEVTLTMKVASGSTGDQKVQISYYGPKTPPVKALLYLTGVDGVSPCHPGWSAMA

SEQ ID NO: 61801 - protein, 694 aa, Homo sapiens
  Payload ID: 12351
  Gene Symbol: PADI6
  Gene Name: peptidyl arginine deiminase, type VI
  Uniprot ID: Q6TGC4
  ENSP ID: ENSP00000483125
MVSVEGRAMSFQSIIHLSLDSPVHAVCVLGTEICLDLSGCAPQKCQCFTIHGSGRVLIDVANTVISEKEDATIWWPLSDPTYATVKMTSPSPSVDADKVSVTYYGPNEDAPVGTAVLYLTGIEVSLEVDIYRNGQVEMSSDKQAKKKWIWGPSGWGAILLVNCNPADVGQQLEDKKTKKVIFSEEITNLSQMTLNVQGPSCILKKYRLVLHTSKEESKKARVYWPQKDNSSTFELVLGPDQHAYTLALLGNHLKETFYVEAIAFPSAEFSGLISYSVSLVEESQDPSIPETVLYKDTVVFRVAPCVFIPCTQVPLEVYLCRELQLQGFVDTVTKLSEKSNSQVASVYEDPNRLGRWLQDEMAFCYTQAPHKTTSLILDTPQAADLDEFPMKYSLSPGIGYMIQDTEDHKVASMDSIGNLMVSPPVKVQGKEYPLGRVLIGSSFYPSAEGRAMSKTLRDFLYAQQVQAPVELYSDWLMTGHVDEFMCFIPTDDKNEGKKGFLLLLASPSACYKLFREKQKEGYGDALLFDELRADQLLSNGREAKTIDQLLADESLKKQNEYVEKCIHLNRDILKTELGLVEQDIIEIPQLFCLEKLTNIPSDQQPKRSFARPYFPDLLRMIVMGKNLGIPKPFGPQIKGTCCLEEKICCLLEPLGFKCTFINDFDCYLTEVGDICACANIRRVPFAFKWWKMVP

SEQ ID NO: 61802 - protein, 887 aa, Homo sapiens
  Payload ID: 12352
  Gene Symbol: PAM
  Gene Name: peptidylglycine alpha-amidating monooxygenase
  Uniprot ID: P19021
  ENSP ID: ENSP00000282992
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKGKGSGGLNLGNFFASRKGYSRKGFDRLSTEGSDQEKEDDGSESEEEYSAPLPALAPSSS

SEQ ID NO: 61803 - protein, 175 aa, Homo sapiens
  Payload ID: 12352
  Gene Symbol: PAM
  Gene Name: peptidylglycine alpha-amidating monooxygenase
  ENSP ID: ENSP00000302544
MAGRVPSLLVLLVFPSSCLAFRSPLSVFKRFKETTRPFSNECLGTTRPVVPIDSSDFALDIRMPGVTPKQLTSSLEPAWILSITCYFLDAICLHPLEVTGFVMKEPVQIKPIFCMPGREMLPLPGSPKVLDSELEERLEVNTLYYRYTMGILVLLEIITRTVLVCPYTSHVCHSL

SEQ ID NO: 61804 - protein, 974 aa, Homo sapiens
  Payload ID: 12352
  Gene Symbol: PAM
  Gene Name: peptidylglycine alpha-amidating monooxygenase
  Uniprot ID: P19021
  ENSP ID: ENSP00000306100
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 61805 - protein, 866 aa, Homo sapiens
  Payload ID: 12352
  Gene Symbol: PAM
  Gene Name: peptidylglycine alpha-amidating monooxygenase
  Uniprot ID: P19021
  ENSP ID: ENSP00000314638
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGDSEHKLETSSGRVLGRFRGKGSGGLNLGNFFASRKGYSRKGFDRLSTEGSDQEKEDDGSESEEEYSAPLPALAPSSS

SEQ ID NO: 61806 - protein, 679 aa, Homo sapiens
  Payload ID: 12352
  Gene Symbol: PAM
  Gene Name: peptidylglycine alpha-amidating monooxygenase
  ENSP ID: ENSP00000369125
  MOD_RES (1)..(1): Any amino acid
XMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKADSEHKLETSSGRVLGRFRGKGSGGLNLGNFFASRKGYSRKGFDRLSTEGSDQEKEDDGSESEEEYSAPLPALAPSSS

SEQ ID NO: 61807 - protein, 973 aa, Homo sapiens [sequence omitted]

SEQ ID NO: 61808 - protein, 905 aa, Homo sapiens
  Payload ID: 12352
  Gene Symbol: PAM
  Gene Name: peptidylglycine alpha-amidating monooxygenase
  Uniprot ID: P19021
  ENSP ID: ENSP00000403461
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKDSEHKLETSSGRVLGRFRGKGSGGLNLGNFFASRKGYSRKGFDRLSTEGSDQEKEDDGSESEEEYSAPLPALAPSSS

SEQ ID NO: 61809 - protein, 25 aa, Homo sapiens
  Payload ID: 12352
  Gene Symbol: PAM
  Gene Name: peptidylglycine alpha-amidating monooxygenase
  ENSP ID: ENSP00000420851
MAGRVPSLLVLLVFPSSCLAFRSPL

SEQ ID NO: 61810 - protein, 29 aa, Homo sapiens
  Payload ID: 12352
  Gene Symbol: PAM
  Gene Name: peptidylglycine alpha-amidating monooxygenase
  ENSP ID: ENSP00000421569
MAGRVPSLLVLLVFPSSCLAFRSPLSVFK

SEQ ID NO: 61811 - protein, 42 aa, Homo sapiens
  Payload ID: 12352
  Gene Symbol: PAM
  Gene Name: peptidylglycine alpha-amidating monooxygenase
  ENSP ID: ENSP00000421823
MAGRVPSLLVLLVFPSSCLAFRSPLSVFKRFKETTRPFSNEC

SEQ ID NO: 61812 - protein, 28 aa, Homo sapiens
  Payload ID: 12352
  Gene Symbol: PAM
  Gene Name: peptidylglycine alpha-amidating monooxygenase
  ENSP ID: ENSP00000423611
MAGRVPSLLVLLVFPSSCLAFRSPLSVF

SEQ ID NO: 61813 - protein, 53 aa, Homo sapiens
  Payload ID: 12352
  Gene Symbol: PAM
  Gene Name: peptidylglycine alpha-amidating monooxygenase
  ENSP ID: ENSP00000423763
MAGRVPSLLVLLVFPSSCLAFRSPLSVFKRFKETTRPFSNECLGTTRPVVPID

SEQ ID NO: 61814 - protein, 250 aa, Homo sapiens
  Payload ID: 12352
  Gene Symbol: PAM
  Gene Name: peptidylglycine alpha-amidating monooxygenase
  ENSP ID: ENSP00000424203
  MOD_RES (1)..(1): Any amino acid
XRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGGKGSGGLNLGNFFASRKGYSRKGFDRLSTEGSDQEKEDDGSESEEEYSAPLPALAPSSS

SEQ ID NO: 61815 - protein, 68 aa, Homo sapiens
  Payload ID: 12352
  Gene Symbol: PAM
  Gene Name: peptidylglycine alpha-amidating monooxygenase
  ENSP ID: ENSP00000426448
MAGRVPSLLVLLVFPSSCLAFRSPLSVFKRFKETTRPFSNECLGTTRPVVPIDSSDFALDIRMPGVTP

SEQ ID NO: 61816 - protein, 163 aa, Homo sapiens
  Payload ID: 12353
  Gene Symbol: PIN1
  Gene Name: peptidylprolyl cis/trans isomerase, NIMA-interacting 1
  Uniprot ID: Q13526
  ENSP ID: ENSP00000247970
MADEEKLPPGWEKRMSRSSGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGQMQKPFEDASFALRTGEMSGPVFTDSGIHIILRTE

SEQ ID NO: 61817 - protein, 145 aa, Homo sapiens
  Payload ID: 12353
  Gene Symbol: PIN1
  Gene Name: peptidylprolyl cis/trans isomerase, NIMA-interacting 1
  ENSP ID: ENSP00000466656
MADEEKLPPGWEKRMSRSSGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGAQGMGLTRLGDPYHPEG

SEQ ID NO: 61818 - protein, 90 aa, Homo sapiens
  Payload ID: 12353
  Gene Symbol: PIN1
  Gene Name: peptidylprolyl cis/trans isomerase, NIMA-interacting 1
  ENSP ID: ENSP00000466780
  MOD_RES (1)..(1): Any amino acid
XQEKITRTKEEALELINGYIQKIKSGEEDFESLASQFSDCSSAKARGDLGAFSRGQMQKPFEDASFALRTGEMSGPVFTDSGIHIILRTE

SEQ ID NO: 61819 - protein, 163 aa, Homo sapiens; identical to SEQ ID NO: 61816
  Payload ID: 12353
  Gene Symbol: PIN1
  Gene Name: peptidylprolyl cis/trans isomerase, NIMA-interacting 1
  Uniprot ID: Q13526
  ENSP ID: ENSP00000466962

SEQ ID NO: 61820 - protein, 50 aa, Homo sapiens
  Payload ID: 12353
  Gene Symbol: PIN1
  Gene Name: peptidylprolyl cis/trans isomerase, NIMA-interacting 1
  ENSP ID: ENSP00000467197
  MOD_RES (1)..(1): Any amino acid
XADEEKLPPGWEKRMSRSSGENTKAQGRYITFEPRFRFESRPSVLLQPHH

SEQ ID NO: 61821 - protein, 111 aa, Homo sapiens
  Payload ID: 12354
  Gene Symbol: PIN4
  Gene Name: peptidylprolyl cis/trans isomerase, NIMA-interacting 4
  ENSP ID: ENSP00000218432
MPMAGLLKGLVRQLERFSVQQQASKMPPKGKSGSGKAGKGGAASGSDSADKKAQGPKGGGNAVKVRHILCEKHGKIMEAMEKLKSGMRFNEVAAQYSEDKARQGVCCSYYL

SEQ ID NO: 61822 - protein, 156 aa, Homo sapiens
  Payload ID: 12354
  Gene Symbol: PIN4
  Gene Name: peptidylprolyl cis/trans isomerase, NIMA-interacting 4
  Uniprot ID: Q9Y237
  ENSP ID: ENSP00000362773
MPMAGLLKGLVRQLERFSVQQQASKMPPKGKSGSGKAGKGGAASGSDSADKKAQGPKGGGNAVKVRHILCEKHGKIMEAMEKLKSGMRFNEVAAQYSEDKARQGGDLGWMTRGSMVGPFQEAAFALPVSGMDKPVFTDPPVKTKFGYHIIMVEGRK

SEQ ID NO: 61823 - protein, 91 aa, Homo sapiens
  Payload ID: 12354
  Gene Symbol: PIN4
  Gene Name: peptidylprolyl cis/trans isomerase, NIMA-interacting 4
  ENSP ID: ENSP00000394066
VQQQASKMPPKGKSGSGKAGKGGAASGSDSADKKAQGPKGGGNAVKVRHILCEKHGKIMEAMEKLKSGMRFNEVAAQYSEDKARQGAFRLR

SEQ ID NO: 61824 - protein, 116 aa, Homo sapiens
  Payload ID: 12354
  Gene Symbol: PIN4
  Gene Name: peptidylprolyl cis/trans isomerase, NIMA-interacting 4
  ENSP ID: ENSP00000402330
  MOD_RES (1)..(1): Any amino acid
XKEKVVLEKRGKVERPERSRRMGAGEERREGTDSPSPESGTDAAGGAASGSDSADKKAQGPKGGGNAVKVRHILCEKHGKIMEAMEKLKSGMRFNEVAAQYSEDKARQGVCCSYYL

SEQ ID NO: 61825 - protein, 133 aa, Homo sapiens
  Payload ID: 12354
  Gene Symbol: PIN4
  Gene Name: peptidylprolyl cis/trans isomerase, NIMA-interacting 4
  Uniprot ID: Q9Y237
  ENSP ID: ENSP00000409154
MPMAGLLKGLVRQLERFSVQQQASKMPPKGKSGSGKAGKGGAASGSDSADKKAQGPKGGGNAVKVRHILCEKHGKIMEAMEKLKSGMRFNEVAAQYSEDKARQGIPSLQQHAGHHRDLRSTLISLVSYLQTTP

SEQ ID NO: 61826 - protein, 106 aa, Homo sapiens
  Payload ID: 12354
  Gene Symbol: PIN4
  Gene Name: peptidylprolyl cis/trans isomerase, NIMA-interacting 4
  ENSP ID: ENSP00000421392
MPMAGLLKGLVRQLERFSVQQQASKMPPKGKSGSGKAGKACQLSLVLAYFVWPKIILPLWPREAERLDTLVVKCLAEFPFEVWRYDGNIHSGCVLDLSVNMEVQFK

SEQ ID NO: 61827 - protein, 115 aa, Homo sapiens
  Payload ID: 12354
  Gene Symbol: PIN4
  Gene Name: peptidylprolyl cis/trans isomerase, NIMA-interacting 4
  ENSP ID: ENSP00000421676
VQQQASKMPPKGKSGSGKAGKGGAASGSDSADKKAQGPKGGGNAVKVRHILCEKHGKIMEAMEKLKSGMRFNEVAAQYSEDKARQGIPSLQQHAGHHRDLRSTLISLVSYLQTTP

SEQ ID NO: 61828 - protein, 166 aa, Homo sapiens
  Payload ID: 12355
  Gene Symbol: PPIL1
  Gene Name: peptidylprolyl isomerase (cyclophilin)-like 1
  Uniprot ID: Q9Y3C6
  ENSP ID: ENSP00000362803
MAAIPPDSWQPPNVYLETSMGIIVLELYWKHAPKTCKNFAELARRGYYNGTKFHRIIKDFMIQGGDPTGTGRGGASIYGKQFEDELHPDLKFTGAGILAMANAGPDTNGSQFFVTLAPTQWLDGKHTIFGRVCQGIGMVNRVGMVETNSQDRPVDDVKIIKAYPSG

SEQ ID NO: 61829 - protein, 520 aa, Homo sapiens
  Payload ID: 12356
  Gene Symbol: PPIL2
  Gene Name: peptidylprolyl isomerase (cyclophilin)-like 2
  Uniprot ID: Q13356
  ENSP ID: ENSP00000334553
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 61830 - protein, 520 aa, Homo sapiens; identical to SEQ ID NO: 61829
  Payload ID: 12356
  Gene Symbol: PPIL2
  Gene Name: peptidylprolyl isomerase (cyclophilin)-like 2
  Uniprot ID: Q13356
  ENSP ID: ENSP00000381812

SEQ ID NO: 61831 - protein, 520 aa, Homo sapiens; identical to SEQ ID NO: 61829
  Payload ID: 12356
  Gene Symbol: PPIL2
  Gene Name: peptidylprolyl isomerase (cyclophilin)-like 2
  Uniprot ID: Q13356
  ENSP ID: ENSP00000384299

SEQ ID NO: 61832 - protein, 160 aa, Homo sapiens
  Payload ID: 12356
  Gene Symbol: PPIL2
  Gene Name: peptidylprolyl isomerase (cyclophilin)-like 2
  ENSP ID: ENSP00000395181
MGKRQHQKDKIDRFSLCCPSCSPTPGLKQSSCLGLPNCWDYRYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYE

SEQ ID NO: 61833 - protein, 41 aa, Homo sapiens
  Payload ID: 12356
  Gene Symbol: PPIL2
  Gene Name: peptidylprolyl isomerase (cyclophilin)-like 2
  ENSP ID: ENSP00000406745
MGKRQHQKDKMYITCAEYTHFYGGKKPAVKTIKTTITRALS

SEQ ID NO: 61834 - protein, 527 aa, Homo sapiens
  Payload ID: 12356
  Gene Symbol: PPIL2
  Gene Name: peptidylprolyl isomerase (cyclophilin)-like 2
  Uniprot ID: Q13356
  ENSP ID: ENSP00000486725
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATEQQRKSPQPVPLSPCPRRSPVGVLGTSAPGSSRLPDDH

SEQ ID NO: 61835 - protein, 165 aa, Homo sapiens
  Payload ID: 12357
  Gene Symbol: PPIL3
  Gene Name: peptidylprolyl isomerase (cyclophilin)-like 3
  Uniprot ID: Q9H2H8
  ENSP ID: ENSP00000286175
MSVTLHTDVGDIKIEVFCERTPKTCEMESRCVPQAGVQWRDLGSLQPPPPGFKQVFCLSLPRTGRGGNSIWGKKFEDEYSEYLKHNVRGVVSMANNGPNTNGSQFFITYGKQPHLDMKYTVFGKVIDGLETLDELEKLPVNEKTYRPLNDVHIKDITIHANPFAQ

SEQ ID NO: 61836 - protein, 161 aa, Homo sapiens
  Payload ID: 12357
  Gene Symbol: PPIL3
  Gene Name: peptidylprolyl isomerase (cyclophilin)-like 3
  Uniprot ID: Q9H2H8
  ENSP ID: ENSP00000376107
MSVTLHTDVGDIKIEVFCERTPKTCENFLALCASNYYNGCIFHRNIKGFMVQTGDPTGTGRGGNSIWGKKFEDEYSEYLKHNVRGVVSMANNGPNTNGSQFFITYGKQPHLDMKYTVFGKVIDGLETLDELEKLPVNEKTYRPLNDVHIKDITIHANPFAQ

SEQ ID NO: 61837 - protein, 157 aa, Homo sapiens
  Payload ID: 12357
  Gene Symbol: PPIL3
  Gene Name: peptidylprolyl isomerase (cyclophilin)-like 3
  ENSP ID: ENSP00000386235
MSVTLHTDVGDIKIEVFCERTPKTCEAGVQWRDLGSLQPPPPGFKQVFCLSLPRTGRGGNSIWGKKFEDEYSEYLKHNVRGVVSMANNGPNTNGSQFFITYGKQPHLDMKYTVFGKVIDGLETLDELEKLPVNEKTYRPLNDVHIKDITIHANPFAQ

SEQ ID NO: 61838 - protein, 180 aa, Homo sapiens
  Payload ID: 12357
  Gene Symbol: PPIL3
  Gene Name: peptidylprolyl isomerase (cyclophilin)-like 3
  ENSP ID: ENSP00000386893
LRLHFSCFNNGCARRSGEAQSVTLHTDVGDIKIEVFCERTPKTCENFLALCASNYYNGCIFHRNIKGFMVQTGDPTGTGRGGNSIWGKKFEDEYSEYLKHNVRGVVSMANNGPNTNGSQFFITYGKQPHLDMKYTVFGKVIDGLETLDELEKLPVNEKTYRPLNDVHIKDITIHANPFAQ

SEQ ID NO: 61839 - protein, 165 aa, Homo sapiens; identical to SEQ ID NO: 61835
  Payload ID: 12357
  Gene Symbol: PPIL3
  Gene Name: peptidylprolyl isomerase (cyclophilin)-like 3
  Uniprot ID: Q9H2H8
  ENSP ID: ENSP00000387012

SEQ ID NO: 61840 - protein, 73 aa, Homo sapiens
  Payload ID: 12357
  Gene Symbol: PPIL3
  Gene Name: peptidylprolyl isomerase (cyclophilin)-like 3
  ENSP ID: ENSP00000391082
MSVTLHTDVGDIKIEVFCERTPKTCEELEEEATVFGARSLRMNTVNILSTMLEVLYLWLIMARTPMDLSSSSP

SEQ ID NO: 61841 - protein, 53 aa, Homo sapiens
  Payload ID: 12357
  Gene Symbol: PPIL3
  Gene Name: peptidylprolyl isomerase (cyclophilin)-like 3
  ENSP ID: ENSP00000400726
MSVTLHTDVGDIKIEVFCERTPKTCEEYQGFHGSNRRSNRNWKRRQQYLGQEV

SEQ ID NO: 61842 - protein, 80 aa, Homo sapiens
  Payload ID: 12357
  Gene Symbol: PPIL3
  Gene Name: peptidylprolyl isomerase (cyclophilin)-like 3
  ENSP ID: ENSP00000401196
MSVTLHTDVGDIKIEVFCERTPKTCENFLALCASNYYNGCIFHRNIKGFMVQTGDPTGTGRGGNSIWGKKFEDEYSEYLK

SEQ ID NO: 61843 - protein, 492 aa, Homo sapiens
  Payload ID: 12358
  Gene Symbol: PPIL4
  Gene Name: peptidylprolyl isomerase (cyclophilin)-like 4
  Uniprot ID: Q8WUA2
  ENSP ID: ENSP00000253329
MAVLLETTLGDVVIDLYTEERPRACLNFLKLCKIKYYNYCLIHNVQRDFIIQTGDPTGTGRGGESIFGQLYGDQASFFEAEKVPRIKHKKKGTVSMVNNGSDQHGSQFLITTGENLDYLDGVHTVFGEVTEGMDIIKKINETFVDKDFVPYQDIRINHTVILDDPFDDPPDLLIPDRSPEPTREQLDSGRIGADEEIDDFKGRSAEEVEEIKAEKEAKTQAILLEMVGDLPDADIKPPENVLFVCKLNPVTTDEDLEIIFSRFGPIRSCEVIRDWKTGESLCYAFIEFEKEEDCEKAFFKMDNVLIDDRRIHVDFSQSVAKVKWKGKGGKYTKSDFKEYEKEQDKPPNLVLKDKVKPKQDTKYDLILDEQAEDSKSSHSHTSKKHKKKTHHCSEEKEDEDYMPIKNTNQDIYREMGFGHYEEEESCWEKQKSEKRDRTQNRSRSRSRERDGHYSNSHKSKYQTDLYERERSKKRDRSRSPKKSKDKEKSKYR

SEQ ID NO: 61844 - protein, 127 aa, Homo sapiens
  Payload ID: 12358
  Gene Symbol: PPIL4
  Gene Name: peptidylprolyl isomerase (cyclophilin)-like 4
  ENSP ID: ENSP00000344128
MSRPKTQNQVTHTQVKNTRRKPITVLKRKKMRTTCQSKILIRISIEKWGLVTMKKKKAVGRNKRVKRETELRTEVVADLERGMAIIVIVINQNTKQIFMKEKGVKRETEAEVQRSPKIKKNLSIDER

SEQ ID NO: 61845 - protein, 263 aa, Homo sapiens
  Payload ID: 12359
  Gene Symbol: PPIL6
  Gene Name: peptidylprolyl isomerase (cyclophilin)-like 6
  ENSP ID: ENSP00000389292
MARPQPCGPPHARCGSPSLPERPLQVKVVGLFSCPNFQIAKSAAENLKNNHPSKFEDPILVPLQEFAWHQYLQEKKRELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEDGVSLSPMLECNGVISAHCNLHLPGSSDSPASAS

SEQ ID NO: 61846 - protein, 337 aa, Homo sapiens
  Payload ID: 12359
  Gene Symbol: PPIL6
  Gene Name: peptidylprolyl isomerase (cyclophilin)-like 6
  Uniprot ID: Q8IXY8
  ENSP ID: ENSP00000392257
MARPQPCGPPHARCGSPSLPERPLQVKVVGLFSCPNFQIAKSAAENLKNNHPSKFEDPILVPLQEFAWHQYLQEKKRELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEELYGSLKRSVKRQKESRGVGKIEKYRDENFSVPHNKRGVLGMANKGRHSNGSQFYITLQATPYLDRKFVAFGQLIEGTEVLKQLELVPTQNERPIHMCRITDSGDPYA

SEQ ID NO: 61847 - protein, 279 aa, Homo sapiens
  Payload ID: 12359
  Gene Symbol: PPIL6
  Gene Name: peptidylprolyl isomerase (cyclophilin)-like 6
  Uniprot ID: Q8IXY8
  ENSP ID: ENSP00000407731
MARPQPCGPPHARCGSPSLPERPLQVKVVGLFSCPNFQIAKSAAEELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEDENFSVPHNKRGVLGMANKGRHSNGSQFYITLQATPYLDRKFVAFGQLIEGTEVLKQLELVPTQNERPIHMCRITDSGDPYA

SEQ ID NO: 61848 - protein, 205 aa, Homo sapiens
  Payload ID: 12359
  Gene Symbol: PPIL6
  Gene Name: peptidylprolyl isomerase (cyclophilin)-like 6
  ENSP ID: ENSP00000411731
ARCGSPSLPERPLQVKVVGLFSCPNFQIAKSAAEELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEDENFSVPHNKRGVLGMANK

SEQ ID NO: 61849 - protein, 171 aa, Homo sapiens
  Payload ID: 12359
  Gene Symbol: PPIL6
  Gene Name: peptidylprolyl isomerase (cyclophilin)-like 6
  ENSP ID: ENSP00000427899
  MOD_RES (1)..(1): Any amino acid
XGLFSCPNFQIAKSAAEELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEGN

SEQ ID NO: 61850 - protein, 311 aa, Homo sapiens
  Payload ID: 12359
  Gene Symbol: PPIL6
  Gene Name: peptidylprolyl isomerase (cyclophilin)-like 6
  Uniprot ID: Q8IXY8
  ENSP ID: ENSP00000427929
MARPQPCGPPHARCGSPSLPERPLQVKVVGLFSCPNFQIAKSAAENLKNNHPSKFEDPILVPLQEFAWHQYLQEKKRELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEDENFSVPHNKRGVLGMANKGRHSNGSQFYITLQATPYLDRKFVAFGQLIEGTEVLKQLELVPTQNERPIHMCRITDSGDPYA

SEQ ID NO: 61851 - protein, 146 aa, Homo sapiens
  Payload ID: 12359
  Gene Symbol: PPIL6
  Gene Name: peptidylprolyl isomerase (cyclophilin)-like 6
  ENSP ID: ENSP00000430998
  MOD_RES (1)..(1): Any amino acid
XRPLQVKVVGLFSCPNFQIAKSAAEELKNETWEYSSSVISFVNGQFLGDALDLQKWAHEVWDIVDIKPSALYDALTEDFSAKFLRDTKVLCTGKAGFSQRGIRLHYKNSIFHRIVQNGWIQGGDIVYGKGDNGESIYGPTFEDENF

SEQ ID NO: 61852 - protein, 120 aa, Homo sapiens
  Payload ID: 12360
  Gene Symbol: PPIA
  Gene Name: peptidylprolyl isomerase A (cyclophilin A)
  ENSP ID: ENSP00000394670
MVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTE

SEQ ID NO: 61853 - protein, 121 aa, Homo sapiens
  Payload ID: 12360
  Gene Symbol: PPIA
  Gene Name: peptidylprolyl isomerase A (cyclophilin A)
  ENSP ID: ENSP00000405975
MVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEW

SEQ ID NO: 61854 - protein, 165 aa, Homo sapiens
  Payload ID: 12360
  Gene Symbol: PPIA
  Gene Name: peptidylprolyl isomerase A (cyclophilin A)
  Uniprot ID: P62937
  ENSP ID: ENSP00000419425
MVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 61855 - protein, 105 aa, Homo sapiens
  Payload ID: 12360
  Gene Symbol: PPIA
  Gene Name: peptidylprolyl isomerase A (cyclophilin A)
  Uniprot ID: P62937
  ENSP ID: ENSP00000427976
MCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 61856 - protein, 58 aa, Homo sapiens
  Payload ID: 12360
  Gene Symbol: PPIA
  Gene Name: peptidylprolyl isomerase A (cyclophilin A)
  ENSP ID: ENSP00000429251
MVNPTVFFDIAVDGEPLGRVSFECVSMHGVRKKPSYNSTKSSMDGCVGAGLSHVFGVE

SEQ ID NO: 61857 - protein, 105 aa, Homo sapiens; identical to SEQ ID NO: 61855
  Payload ID: 12360
  Gene Symbol: PPIA
  Gene Name: peptidylprolyl isomerase A (cyclophilin A)
  Uniprot ID: P62937
  ENSP ID: ENSP00000430817

SEQ ID NO: 61858 - protein, 105 aa, Homo sapiens; identical to SEQ ID NO: 61855
  Payload ID: 12360
  Gene Symbol: PPIA
  Gene Name: peptidylprolyl isomerase A (cyclophilin A)
  Uniprot ID: P62937
  ENSP ID: ENSP00000479961

SEQ ID NO: 61859 - protein, 164 aa, Homo sapiens
  Payload ID: 12361
  Gene Symbol: PPIAL4A
  Gene Name: peptidylprolyl isomerase A (cyclophilin A)-like 4A
  Uniprot ID: Q9Y536
  ENSP ID: ENSP00000485206
MVNSVVFFDITVDGKPLGRISIKLFADKILKTAENFRALSTGEKGFRYKGSCFHRIIPGFMCQGGDFTRHNGTGDKSIYGEKFDDENLIRKHTGSGILSMANAGPNTNGSQFFICAAKTEWLDGKHVAFGKVKERVNIVEAMEHFGYRNSKTSKKITIADCGQF

SEQ ID NO: 61860 - protein, 164 aa, Homo sapiens
  Payload ID: 12362
  Gene Symbol: PPIAL4C
  Gene Name: peptidylprolyl isomerase A (cyclophilin A)-like 4C
  Uniprot ID: A0A0B4J2A2
  ENSP ID: ENSP00000463057
MVNSVVFFDITVDGKPLGRISIKLFADKIPKTAENFRALSTGEKGFRYKGSCFHRIIPGFMCQGGDFTRPNGTGDKSIYGEKFDDENLIRKHTGSGILSMANAGPNTNGSQFFICTAKTEWLDGKHVAFGKVKERVNIVEAMEHFGYRNSKTSKKITIADCGQF

SEQ ID NO: 61861 - protein, 164 aa, Homo sapiens
  Payload ID: 12363
  Gene Symbol: PPIAL4D
  Gene Name: peptidylprolyl isomerase A (cyclophilin A)-like 4D
  Uniprot ID: F5H284
  ENSP ID: ENSP00000439444
MVNSVVFFEITRDGKPLGRISIKLFADKIPKTAENFRALSTGEKGFRYKGSCFHRIIPGFMCQGGDFTRPNGTGDKSIYGEKFDDENLIRKHTGSGILSMANAGPNTNGSQFFICAAKTEWLDGKHVAFGKVKERVNIVEATEHFGYRNSKTSKKITIADCGQF

SEQ ID NO: 61862 - protein, 164 aa, Homo sapiens
  Payload ID: 12364
  Gene Symbol: PPIAL4E
  Gene Name: peptidylprolyl isomerase A (cyclophilin A)-like 4E
  Uniprot ID: A0A075B759
  ENSP ID: ENSP00000463419
MVNSVVFFEITRDGKPLGRISIKLFADKIPKTAENFRALSTGEKGFRYKGSCFHRIIPGFMCQGGDFTRPNGTGDKSIYGEKFDDENLIRKHTGSGILSMANAGPNTNGSQFFICAAKTEWLDGKHVAFGKVKERVNIVEAMEHFGYRNSKTSKKITIADCGQF

SEQ ID NO: 61863 - protein, 164 aa, Homo sapiens
  Payload ID: 12365
  Gene Symbol: PPIAL4F
  Gene Name: peptidylprolyl isomerase A (cyclophilin A)-like 4F
  ENSP ID: ENSP00000358224
MVNSVVFFEITRDGKPLGRISIKLFADKIPKTAENFRALSTGEKGFRYKGSCFHRIIPGFMCQGGDFTRPNGTGDKSIYGEKFDDENLIRKHTGSGILSMANAGPNTSGSQFFICAAKTEWLDGKHVAFGKVKERVNIVEATEHFGYRNSKTSKKITIADCGQF

SEQ ID NO: 61864 - protein, 164 aa, Homo sapiens; identical to SEQ ID NO: 61862
  Payload ID: 12365
  Gene Symbol: PPIAL4F
  Gene Name: peptidylprolyl isomerase A (cyclophilin A)-like 4F
  Uniprot ID: P0DN26
  ENSP ID: ENSP00000485638

SEQ ID NO: 61865 - protein, 164 aa, Homo sapiens
  Payload ID: 12366
  Gene Symbol: PPIAL4G
  Gene Name: peptidylprolyl isomerase A (cyclophilin A)-like 4G
  Uniprot ID: P0DN37
  ENSP ID: ENSP00000393845
MVNSVIFFDITVDGKPLGRISIKQFADKIPKTAENFRALSTGEKGFRYKGSCFHRIIPGFMCQGGDFTHPNGTGDKSIYGEKFDDENLIRKHTGSGILSMANAGPNTNGSQFFICTAKTEWLDGKHVAFGKVKERVNIVEAMEHFGYRNSKTSKKITIADCGQF

SEQ ID NO: 61866 - protein, 216 aa, Homo sapiens
  Payload ID: 12367
  Gene Symbol: PPIB
  Gene Name: peptidylprolyl isomerase B (cyclophilin B)
  Uniprot ID: P23284
  ENSP ID: ENSP00000300026
MLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 61867 - protein, 212 aa, Homo sapiens
  Payload ID: 12368
  Gene Symbol: PPIC
  Gene Name: peptidylprolyl isomerase C (cyclophilin C)
  Uniprot ID: P45877
  ENSP ID: ENSP00000303057
MGPGPRLLLPLVLCVGLGALVFSSGAEGFRKRGPSVTAKVFFDVRIGDKDVGRIVIGLFGKVVPKTVENFVALATGEKGYGYKGSKFHRVIKDFMIQGGDITTGDGTGGVSIYGETFPDENFKLKHYGIGWVSMANAGPDTNGSQFFITLTKPTWLDGKHVVFGKVIDGMTVVHSIELQATDGHDRPLTNCSIINSGKIDVKTPFVVEIADW

SEQ ID NO: 61868 - protein, 370 aa, Homo sapiens
  Payload ID: 12369
  Gene Symbol: PPID
  Gene Name: peptidylprolyl isomerase D
  Uniprot ID: Q08752
  ENSP ID: ENSP00000303754
MSHPSPQAKPSNPSNPRVFFDVDIGGERVGRIVLELFADIVPKTAENFRALCTGEKGIGHTTGKPLHFKGCPFHRIIKKFMIQGGDFSNQNGTGGESIYGEKFEDENFHYKHDREGLLSMANAGRNTNGSQFFITTVPTPHLDGKHVVFGQVIKGIGVARILENVEVKGEKPAKLCVIAECGELKEGDDGGIFPKDGSGDSHPDFPEDADIDLKDVDKILLITEDLKNIGNTFFKSQNWEMAIKKYAEVLRYVDSSKAVIETADRAKLQPIALSCVLNIGACKLKMSNWQGAIDSCLEALELDPSNTKALYRRAQGWQGLKEYDQALADLKKAQGIAPEDKAIQAELLKVKQKIKAQKDKEKAVYAKMFA

SEQ ID NO: 61869 - protein, 48 aa, Homo sapiens
  Payload ID: 12369
  Gene Symbol: PPID
  Gene Name: peptidylprolyl isomerase D
  ENSP ID: ENSP00000421221
KALYRRAQGWQGLKEYDQALADLKKAQGIAPEDKGKLAAFVVKVNFVI

SEQ ID NO: 61870 - protein, 19 aa, Homo sapiens
  Payload ID: 12369
  Gene Symbol: PPID
  Gene Name: peptidylprolyl isomerase D
  ENSP ID: ENSP00000423207
  MOD_RES (1)..(1): Any amino acid
XILENVEVKGEKPAKNVEN

SEQ ID NO: 61871 - protein, 646 aa, Homo sapiens
  Payload ID: 12370
  Gene Symbol: PPWD1
  Gene Name: peptidylprolyl isomerase domain and WD repeat containing 1
  Uniprot ID: Q96BP3
  ENSP ID: ENSP00000261308
MAAESGSDFQQRRRRRRDPEEPEKTELSERELAVAVAVSQENDEENEERWVGPLPVEATLAKKRKVLEFERVYLDNLPSASMYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRCVRILGKQENIRVMQLALFQGIAKKHRAATTIEMKASENPVLQNIQADPTIVCTSFKKNRFYMFTKREPEDTKSADSDRDVFNEKPSKEEVMAATQAEGPKRVSDSAIIHTSMGDIHTKLFPVECPKTVENFCVHSRNGYYNGHTFHRIIKGFMIQTGDPTGTGMGGESIWGGEFEDEFHSTLRHDRPYTLSMANAGSNTNGSQFFITVVPTPWLDNKHTVFGRVTKGMEVVQRISNVKVNPKTDKPYEDVSIINITVK

SEQ ID NO: 61872 - protein, 132 aa, Homo sapiens
  Payload ID: 12370
  Gene Symbol: PPWD1
  Gene Name: peptidylprolyl isomerase domain and WD repeat containing 1
  ENSP ID: ENSP00000421595
YKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRG

SEQ ID NO: 61873 - protein, 241 aa, Homo sapiens
  Payload ID: 12370
  Gene Symbol: PPWD1
  Gene Name: peptidylprolyl isomerase domain and WD repeat containing 1
  ENSP ID: ENSP00000423234
MYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESL

SEQ ID NO: 61874 - protein, 68 aa, Homo sapiens
  Payload ID: 12370
  Gene Symbol: PPWD1
  Gene Name: peptidylprolyl isomerase domain and WD repeat containing 1
  ENSP ID: ENSP00000423486
MAAESGSDFQQRRRRRRDPEEPEKTELSERELAVAVAVSQENDEENEERWVGPLPVEATLAKKRKAAT

SEQ ID NO: 61875 - protein, 107 aa, Homo sapiens
  Payload ID: 12370
  Gene Symbol: PPWD1
  Gene Name: peptidylprolyl isomerase domain and WD repeat containing 1
  ENSP ID: ENSP00000424519
MAAESGSDFQQRRRRRRDPEEPEKTELSERELAVAVAVSQENDEENEERWVGPLPVEATLAKKRKVLEFERVYLDNLPSASMYERSYMHRDVITHVVCTKFYYYCQS

SEQ ID NO: 61876 - protein, 84 aa, Homo sapiens
  Payload ID: 12370
  Gene Symbol: PPWD1
  Gene Name: peptidylprolyl isomerase domain and WD repeat containing 1
  ENSP ID: ENSP00000425390
MAAESGSDFQQRRRRRRDPEEPEKTELSERELAVAVAVSQENDEENEERWVGPLPVEATLAKKRKEQILLLLPVMMDMSSSGKK

SEQ ID NO: 61877 - protein, 107 aa, Homo sapiens
  Payload ID: 12370
  Gene Symbol: PPWD1
  Gene Name: peptidylprolyl isomerase domain and WD repeat containing 1
  ENSP ID: ENSP00000427054
MDLRTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKI

SEQ ID NO: 61878 - protein, 108 aa, Homo sapiens
  Payload ID: 12370
  Gene Symbol: PPWD1
  Gene Name: peptidylprolyl isomerase domain and WD repeat containing 1
  ENSP ID: ENSP00000427642
MAAESGSDFQQRRRRRRDPEEPEKTELSERELAVAVAVSQENDEENEERWVGPLPVEATLAKKRKVLEFERVYLDNLPSASMYERSYMHRDVITHVVCTKQWKVIQRI

SEQ ID NO: 61879 - protein, 616 aa, Homo sapiens
  Payload ID: 12370
  Gene Symbol: PPWD1
  Gene Name: peptidylprolyl isomerase domain and WD repeat containing 1
  ENSP ID: ENSP00000442371
MRRTKSAGLDLYLWRQHWPRRGKQPHEVGISNSYLVLEFERVYLDNLPSASMYERSYMHRDVITHVVCTKTDFIITASHDGHVKFWKKIEEGIEFVKHFRSHLGVIESIAVSSEGALFCSVGDDKAMKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRCVRILGKQENIRVMQLALFQGIAKKHRAATTIEMKASENPVLQNIQADPTIVCTSFKKNRFYMFTKREPEDTKSADSDRDVFNEKPSKEEVMAATQAEGPKRVSDSAIIHTSMGDIHTKLFPVECPKTVENFCVHSRNGYYNGHTFHRIIKGFMIQTGDPTGTGMGGESIWGGEFEDEFHSTLRHDRPYTLSMANAGSNTNGSQFFITVVPTPWLDNKHTVFGRVTKGMEVVQRISNVKVNPKTDKPYEDVSIINITVK

SEQ ID NO: 61880 - protein, 490 aa, Homo sapiens
  Payload ID: 12370
  Gene Symbol: PPWD1
  Gene Name: peptidylprolyl isomerase domain and WD repeat containing 1
  Uniprot ID: Q96BP3
  ENSP ID: ENSP00000444496
MKVFDVVNFDMINMLKLGYFPGQCEWIYCPGDAISSVAASEKSTGKIFIYDGRGDNQPLHIFDKLHTSPLTQIRLNPVYKAVVSSDKSGMIEYWTGPPHEYKFPKNVNWEYKTDTDLYEFAKCKAYPTSVCFSPDGKKIATIGSDRKVRIFRFVTGKLMRVFDESLSMFTELQQMRQQLPDMEFGRRMAVERELEKVDAVRLINIVFDETGHFVLYGTMLGIKVINVETNRCVRILGKQENIRVMQLALFQGIAKKHRAATTIEMKASENPVLQNIQADPTIVCTSFKKNRFYMFTKREPEDTKSADSDRDVFNEKPSKEEVMAATQAEGPKRVSDSAIIHTSMGDIHTKLFPVECPKTVENFCVHSRNGYYNGHTFHRIIKGFMIQTGDPTGTGMGGESIWGGEFEDEFHSTLRHDRPYTLSMANAGSNTNGSQFFITVVPTPWLDNKHTVFGRVTKGMEVVQRISNVKVNPKTDKPYEDVSIINITVK

SEQ ID NO: 61881 - protein, 301 aa, Homo sapiens
  Payload ID: 12371
  Gene Symbol: PPIE
  Gene Name: peptidylprolyl isomerase E (cyclophilin E)
  Uniprot ID: Q9UNP9
  ENSP ID: ENSP00000312769
MATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 61882 - protein, 296 aa, Homo sapiens
  Payload ID: 12371
  Gene Symbol: PPIE
  Gene Name: peptidylprolyl isomerase E (cyclophilin E)
  Uniprot ID: Q9UNP9
  ENSP ID: ENSP00000348904
MATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEKQEESAITSQPRSWKLT

SEQ ID NO: 61883 - protein, 314 aa, Homo sapiens
  Payload ID: 12371
  Gene Symbol: PPIE
  Gene Name: peptidylprolyl isomerase E (cyclophilin E)
  Uniprot ID: Q9UNP9
  ENSP ID: ENSP00000361918
MATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEVAPDTKASKARGSRKNKDGQERNWGKSQKVESHTI

SEQ ID NO: 61884 - protein, 250 aa, Homo sapiens
  Payload ID: 12371
  Gene Symbol: PPIE
  Gene Name: peptidylprolyl isomerase E (cyclophilin E)
  ENSP ID: ENSP00000361925
MATTKRVLYVGGLAEEVDDKVLHAAFIPFGDITDIQIPLDYETVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 61885 - protein, 208 aa, Homo sapiens
  Payload ID: 12371
  Gene Symbol: PPIE
  Gene Name: peptidylprolyl isomerase E (cyclophilin E)
  ENSP ID: ENSP00000431714
MATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQERISAACALMKRALALREAASTASSPSSCARAVISQTTMALGASPSMGRSSMMKTLSSSIRDQVYYPWPTLAQTPMALSSS

SEQ ID NO: 61886 - protein, 37 aa, Homo sapiens
  Payload ID: 12371
  Gene Symbol: PPIE
  Gene Name: peptidylprolyl isomerase E (cyclophilin E)
  ENSP ID: ENSP00000432396
ATTKRVLWTGRGSGRQSSSCCVHSFWRHHRYSDSSGL

SEQ ID NO: 61887 - protein, 213 aa, Homo sapiens
  Payload ID: 12371
  Gene Symbol: PPIE
  Gene Name: peptidylprolyl isomerase E (cyclophilin E)
  ENSP ID: ENSP00000433475
MNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIE

SEQ ID NO: 61888 - protein, 36 aa, Homo sapiens
  Payload ID: 12371
  Gene Symbol: PPIE
  Gene Name: peptidylprolyl isomerase E (cyclophilin E)
  ENSP ID: ENSP00000434888
  MOD_RES (1)..(1): Any amino acid
XTKRVLWTGRGSGRQSSSCCVHSFWRHHRYSDSSGL

SEQ ID NO: 61889 - protein, 38 aa, Homo sapiens
  Payload ID: 12371
  Gene Symbol: PPIE
  Gene Name: peptidylprolyl isomerase E (cyclophilin E)
  ENSP ID: ENSP00000434989
MATTKRVLWTGRGSGRQSSSCCVHSFWRHHRYSDSSGL

SEQ ID NO: 61890 - protein, 71 aa, Homo sapiens
  Payload ID: 12371
  Gene Symbol: PPIE
  Gene Name: peptidylprolyl isomerase E (cyclophilin E)
  ENSP ID: ENSP00000436689
MNESELFGRTIRVNLAKPMRIKEGSSRPVWSDDDWLKKFSGKTLEENKEEEGSEPPKAETQEGEPIAKKAR

SEQ ID NO: 61891 - protein, 207 aa, Homo sapiens
  Payload ID: 12372
  Gene Symbol: PPIF
  Gene Name: peptidylprolyl isomerase F
  Uniprot ID: P30405
  ENSP ID: ENSP00000225174
MLALRCGSRWLGLLSVPRSVPLRLPAARACSKGSGDPSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGVLSMANAGPNTNGSQFFICTIKTDWLDGKHVVFGHVKEGMDVVKKIESFGSKSGRTSKKIVITDCGQLS

SEQ ID NO: 61892 - protein, 165 aa, Homo sapiens
  Payload ID: 12372
  Gene Symbol: PPIF
  Gene Name: peptidylprolyl isomerase F
  ENSP ID: ENSP00000396388
  MOD_RES (1)..(1): Any amino acid
XSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGVLSMANAGPNTNGSQFFICTIKTDWSMALDDIALHCCSPGSPVLTGWMASMLCSVTSKRAWTS

SEQ ID NO: 61893 - protein, 145 aa, Homo sapiens
  Payload ID: 12372
  Gene Symbol: PPIF
  Gene Name: peptidylprolyl isomerase F
  ENSP ID: ENSP00000473548
MLALRCGSRWLGLLSVPRSVPLRLPAARACSKGSGDPSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGEWGPPLG

SEQ ID NO: 61894 - protein, 754 aa, Homo sapiens
  Payload ID: 12373
  Gene Symbol: PPIG
  Gene Name: peptidylprolyl isomerase G (cyclophilin G)
  Uniprot ID: Q13427
  ENSP ID: ENSP00000260970
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQERSRSKEKSKQLESKSNEHDHSKSKEKDRRAQSRSRECDITKGKHSYNSRTRERSRSRDRSRRVRSRTHDRDRSRSKEYHRYREQEYRRRGRSRSRERRTPPGRSRSKDRRRRRRDSRSSEREESQSRNKDKYRNQESKSSHRKENSESEKRMYSKSRDHNSSNNSREKKADRDQSPFSKIKQSSQDNELKSSMLKNKEDEKIRSSVEKENQKSKGQENDHVHEKNKKFDHESSPGTDEDKSG

SEQ ID NO: 61895 - protein, 739 aa, Homo sapiens
  Payload ID: 12373
  Gene Symbol: PPIG
  Gene Name: peptidylprolyl isomerase G (cyclophilin G)
  ENSP ID: ENSP00000386245
MGIKVQRPRCFFDIAINNQPAGRVVFELFSDVCPKTCENFRCLCTGEKGTGKSTQKPLHYKSCLFHRVVKDFMVQGGDFSEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQERSRSKEKSKQLESKSNEHDHSKSKEKDRRAQSRSRECDITKGKHSYNSRTRERSRSRDRSRRVRSRTHDRDRSRSKEYHRYREQEYRRRGRSRSRERRTPPGRSRSKDRRRRRRDSRSSEREESQSRNKDKYRNQESKSSHRKENSESEKRMYSKSRDHNSSNNSREKKADRDQSPFSKIKQSSQDNELKSSMLKNKEDEKIRSSVEKENQKSKGQENDHVHEKNKKFDHESSPGTDEDKSG

SEQ ID NO: 61896 - protein, 59 aa, Homo sapiens
  Payload ID: 12373
  Gene Symbol: PPIG
  Gene Name: peptidylprolyl isomerase G (cyclophilin G)
  ENSP ID: ENSP00000394202
MGIKVQRPRCFFDIAINNQPAGRVVFELFSDVCPKTCENFRCLCTGEKGTGKSTQKPLH

SEQ ID NO: 61897 - protein, 246 aa, Homo sapiens
  Payload ID: 12373
  Gene Symbol: PPIG
  Gene Name: peptidylprolyl isomerase G (cyclophilin G)
  ENSP ID: ENSP00000402222
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKK

SEQ ID NO: 61898 - protein, 754 aa, Homo sapiens; identical to SEQ ID NO: 61894
  Payload ID: 12373
  Gene Symbol: PPIG
  Gene Name: peptidylprolyl isomerase G (cyclophilin G)
  Uniprot ID: Q13427
  ENSP ID: ENSP00000407083

SEQ ID NO: 61899 - protein, 487 aa, Homo sapiens
  Payload ID: 12373
  Gene Symbol: PPIG
  Gene Name: peptidylprolyl isomerase G (cyclophilin G)
  ENSP ID: ENSP00000408683
MPGLSCGGGRRLAGFSAFSGGGRFEALQRTGPREEENSTGAGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDH

SEQ ID NO: 61900 - protein, 104 aa, Homo sapiens
  Payload ID: 12373
  Gene Symbol: PPIG
  Gene Name: peptidylprolyl isomerase G (cyclophilin G)
  ENSP ID: ENSP00000411643
MGIKVQRPRCFFDIAINNQPAGRVVFELFSDVCPKTCENFRCLCTELSRILWFKVVTSVKEMDEEGNLSMEDFLKTRVSLLNTTKNFSCQWPTEGRIQMVHSSS

SEQ ID NO: 61901 - protein, 357 aa, Homo sapiens
  Payload ID: 12373
  Gene Symbol: PPIG
  Gene Name: peptidylprolyl isomerase G (cyclophilin G)
  Uniprot ID: Q13427
  ENSP ID: ENSP00000435987
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRVGDSFPRDLHNIAFVFLK

SEQ ID NO: 61902 - protein, 177 aa, Homo sapiens
  Payload ID: 12374
  Gene Symbol: PPIH
  Gene Name: peptidylprolyl isomerase H (cyclophilin H)
  Uniprot ID: O43447
  ENSP ID: ENSP00000306614
MAVANSSPVNPVVFFDVSIGGQEVGRMKIELFADVVPKTAENFRQFCTGEFRKDGVPIGYKGSTFHRVIKDFMIQGGDFVNGDGTGVASIYRGPFADENFKLRHSAPGLLSMANSGPSTNGCQFFITCSKCDWLDGKHVVFGKIIDGLLVMRKIENVPTGPNNKPKLPVVISQCGEM

SEQ ID NO: 61903 - protein, 57 aa, Homo sapiens
  Payload ID: 12374
  Gene Symbol: PPIH
  Gene Name: peptidylprolyl isomerase H (cyclophilin H)
  ENSP ID: ENSP00000361629
MKIELFADVVPKTAENFRQFCTGEFRSVSDVFDFFACSRGVFWGCSEGIGEPPAGLE

SEQ ID NO: 61904 - protein, 134 aa, Homo sapiens
  Payload ID: 12374
  Gene Symbol: PPIH
  Gene Name: peptidylprolyl isomerase H (cyclophilin H)
  Uniprot ID: O43447
  ENSP ID: ENSP00000361630
MIAGDSDRRKDGVPIGYKGSTFHRVIKDFMIQGGDFVNGDGTGVASIYRGPFADENFKLRHSAPGLLSMANSGPSTNGCQFFITCSKCDWLDGKHVVFGKIIDGLLVMRKIENVPTGPNNKPKLPVVISQCGEM

SEQ ID NO: 61905 - protein, 144 aa, Homo sapiens
  Payload ID: 12374
  Gene Symbol: PPIH
  Gene Name: peptidylprolyl isomerase H (cyclophilin H)
  ENSP ID: ENSP00000402836
MKIELFADVVPKTAENFRQFCTGEFRKDGVPIGYKGSTFHRVIKDFMIQGGDFVNGDGTGVASIYRGPFADENFKLRHSAPGLLSMANSGPSTNGCQFFITCSKCDWLDGKHVVFGKIIDGLLVMRKIENVPTGPNNKPKLPVV

SEQ ID NO: 61906 - protein, 68 aa, Homo sapiens
  Payload ID: 12374
  Gene Symbol: PPIH
  Gene Name: peptidylprolyl isomerase H (cyclophilin H)
  ENSP ID: ENSP00000405493
MVNWKGLVLPAVTPSLFLFGYRKDGVPIGYKGSTFHRVIKDFMIQGGDFVNVSTIPFLSKTRSFSFCC

SEQ ID NO: 61907 - protein, 96 aa, Homo sapiens
  Payload ID: 12374
  Gene Symbol: PPIH
  Gene Name: peptidylprolyl isomerase H (cyclophilin H)
  ENSP ID: ENSP00000436091
GDGTGVASIYRGPFADENFKLRHSAPGLLSMANSGPSTNGCQFFITCSKCDWLDGKHVVFGKIIDGLLVMRKIENVPTGPNNKPKLPVVISQCGEM

SEQ ID NO: 61908 - protein, 182 aa, Homo sapiens
  Payload ID: 12375
  Gene Symbol: PTRH1
  Gene Name: peptidyl-tRNA hydrolase 1 homolog
  ENSP ID: ENSP00000418219
MRPGGFLGAGQRLSRAMSRCVLEPRPPGKRWMVAGLGNPGLPGTRHSVGMAVLGQLARRLGVAESWTRDRHCAADLALAPLGDAQLVLLRPRRLMNANGRSVARAAELFGLTAEEVYLVHDELDKPLGRLALKLGGSARQCQGCGWVSGARRTLRRFRPMCWAASPLLSRSCCLCCWIEPPT

SEQ ID NO: 61909 - protein, 214 aa, Homo sapiens
  Payload ID: 12375
  Gene Symbol: PTRH1
  Gene Name: peptidyl-tRNA hydrolase 1 homolog
  Uniprot ID: Q86Y79
  ENSP ID: ENSP00000418661
MRPGGFLGAGQRLSRAMSRCVLEPRPPGKRWMVAGLGNPGLPGTRHSVGMAVLGQLARRLGVAESWTRDRHCAADLALAPLGDAQLVLLRPRRLMNANGRSVARAAELFGLTAEEVYLVHDELDKPLGRLALKLGGSARGHNGVRSCISCLNSNAMPRLRVGIGRPAHPEAVQAHVLGCFSPAEQELLPLLLDRATDLILDHIRERSQGPSLGP

SEQ ID NO: 61910 - protein, 214 aa, Homo sapiens; identical to SEQ ID NO: 61909
  Payload ID: 12375
  Gene Symbol: PTRH1
  Gene Name: peptidyl-tRNA hydrolase 1 homolog
  Uniprot ID: Q86Y79
  ENSP ID: ENSP00000439469

SEQ ID NO: 61911 - protein, 172 aa, Homo sapiens
  Payload ID: 12375
  Gene Symbol: PTRH1
  Gene Name: peptidyl-tRNA hydrolase 1 homolog
  ENSP ID: ENSP00000485347
  MOD_RES (1)..(1): Any amino acid
XLSRAMSRCVLEPRPPGKRWMVAGLGNPGLPGTRHSVGMAVLGQLARRLGVAESWTRDRHCAADLALAPLGDAQLVLLRPRRLMNANGRSVARAAELFGLTAEEVYLVHDELDKPLGRLALKLGGSARGHNGVRSCISCLNSNELLPLLLDRATDLILDHIRERSQGPSLGP

SEQ ID NO: 61912 - protein, 137 aa, Homo sapiens
  Payload ID: 12375
  Gene Symbol: PTRH1
  Gene Name: peptidyl-tRNA hydrolase 1 homolog
  ENSP ID: ENSP00000485367
MRPGGFLGAGQRLSRAMSRCVLEPRPPGKRWMFPWCRPQVAGLGNPGLPGTRHSVGMAVLGQLARRLGVAESWTRDRHCAADLALAPLGDAQLVLLRPRRLMNANGRSVARAAELFGLTAEEVYLVHDELDKPLGRL

SEQ ID NO: 61913 - protein, 162 aa, Homo sapiens
  Payload ID: 12375
  Gene Symbol: PTRH1
  Gene Name: peptidyl-tRNA hydrolase 1 homolog
  ENSP ID: ENSP00000485479
  MOD_RES (1)..(1): Any amino acid
XGGFLGAGQRLSRAMSRCVLEPRPPGKRWMVAGLGNPGLPGTRHSVGMAVLGQLARRLGVAESWTRDRHCAADLALAPLGDAQLVLLRPRRLMNANGRSVARAGATMESVPALAASTPMQCQGCGWVSGARRTLRRFRPMCWAASPLLSRSCCLCCWIEPPT

SEQ ID NO: 61914 - protein, 179 aa, Homo sapiens
  Payload ID: 12376
  Gene Symbol: PTRH2
  Gene Name: peptidyl-tRNA hydrolase 2
  Uniprot ID: Q9Y3E5
  ENSP ID: ENSP00000376758
MPSKSLVMEYLAHPSTLGLAVGVACGMCLGWSLRVCFGMLPKSKTSKTHTDTESEASILGDSGEYKMILVVRNDLKMGKGKVAAQCSHAAVSAYKQIQRRNPEMLKQWEYCGQPKVVVKAPDEETLIALLAHAKMLGLTVSLIQDAGRTQIAPGSQTVLGIGPGPADLIDKVTGHLKLY

SEQ ID NO: 61915 - protein, 180 aa, Homo sapiens
  Payload ID: 12376
  Gene Symbol: PTRH2
  Gene Name: peptidyl-tRNA hydrolase 2
  ENSP ID: ENSP00000387180
MMPSKSLVMEYLAHPSTLGLAVGVACGMCLGWSLRVCFGMLPKSKTSKTHTDTESEASILGDSGEYKMILVVRNDLKMGKGKVAAQCSHAAVSAYKQIQRRNPEMLKQWEYCGQPKVVVKAPDEETLIALLAHAKMLGLTVSLIQDAGRTQIAPGSQTVLGIGPGPADLIDKVTGHLKLY

SEQ ID NO: 61916 - protein, 179 aa, Homo sapiens; identical to SEQ ID NO: 61914
  Payload ID: 12376
  Gene Symbol: PTRH2
  Gene Name: peptidyl-tRNA hydrolase 2
  Uniprot ID: Q9Y3E5
  ENSP ID: ENSP00000464327

SEQ ID NO: 61917 - protein, 140 aa, Homo sapiens
  Payload ID: 12377
  Gene Symbol: PTRHD1
  Gene Name: peptidyl-tRNA hydrolase domain containing 1
  Uniprot ID: Q6GMV3
  ENSP ID: ENSP00000330389
MHRGVGPAFRVVRKMAASGAEPQVLVQYLVLRKDLSQAPFSWPAGALVAQACHAATAALHTHRDHPHTAAYLQELGRMRKVVLEAPDETTLKELAETLQQKNIDHMLWLEQPENIATCIALRPYPKEEVGQYLKKFRLFK

SEQ ID NO: 61918 - protein, 555 aa, Homo sapiens
  Payload ID: 12378
  Gene Symbol: PRF1
  Gene Name: perforin 1 (pore forming protein)
  Uniprot ID: P14222
  ENSP ID: ENSP00000362305
MAARLLLLGILLLLLPLPVPAPCHTAARSECKRSHKFVPGAWLAGEGVDVTSLRRSGSFPVDTQRFLRPDGTCTLCENALQEGTLQRLPLALTNWRAQGSGCQRHVTRAKVSSTEAVARDAARSIRNDWKVGLDVTPKPTSNVHVSVAGSHSQAANFAAQKTHQDQYSFSTDTVECRFYSFHVVHTPPLHPDFKRALGDLPHHFNASTQPAYLRLISNYGTHFIRAVELGGRISALTALRTCELALEGLTDNEVEDCLTVEAQVNIGIHGSISAEAKACEEKKKKHKMTASFHQTYRERHSEVVGGHHTSINDLLFGIQAGPEQYSAWVNSLPGSPGLVDYTLEPLHVLLDSQDPRREALRRALSQYLTDRARWRDCSRPCPPGRQKSPRDPCQCVCHGSAVTTQDCCPRQRGLAQLEVTFIQAWGLWGDWFTATDAYVKLFFGGQELRTSTVWDNNNPIWSVRLDFGDVLLATGGPLRLQVWDQDSGRDDDLLGTCDQAPKSGSHEVRCNLNHGHLKFRYHARCLPHLGGGTCLDYVPQMLLGEPPGNRSGAVW

SEQ ID NO: 61919 - protein, 555 aa, Homo sapiens; identical to SEQ ID NO: 61918
  Payload ID: 12378
  Gene Symbol: PRF1
  Gene Name: perforin 1 (pore forming protein)
  Uniprot ID: P14222
  ENSP ID: ENSP00000398568

SEQ ID NO: 61920 - protein, 147 aa, Homo sapiens
  Payload ID: 12379
  Gene Symbol: PRX
  Gene Name: periaxin
  Uniprot ID: Q9BXM0
  ENSP ID: ENSP00000291825
MEARSRSAEELRRAELVEIIVETEAQTGVSGINVAGGGKEGIFVRELREDSPAARSLSLQEGDQLLSARVFFENFKYEDALRLLQCAEPYKVSFCLKRTVPTGDLALRPGTVSGYEIKGPRAKVAKLVRVLSPAPALDCPSDPVSAP

SEQ ID NO: 61921 - protein, 1461 aa, Homo sapiens
  Payload ID: 12379
  Gene Symbol: PRX
  Gene Name: periaxin
  Uniprot ID: Q9BXM0
  ENSP ID: ENSP00000326018
MEARSRSAEELRRAELVEIIVETEAQTGVSGINVAGGGKEGIFVRELREDSPAARSLSLQEGDQLLSARVFFENFKYEDALRLLQCAEPYKVSFCLKRTVPTGDLALRPGTVSGYEIKGPRAKVAKLNIQSLSPVKKKKMVPGALGVPADLAPVDVEFSFPKFSRLRRGLKAEAVKGPVPAAPARRRLQLPRLRVREVAEEAQAARLAAAAPPPRKAKVEAEVAAGARFTAPQVELVGPRLPGAEVGVPQVSAPKAAPSAEAAGGFALHLPTLGLGAPAPPAVEAPAVGIQVPQVELPALPSLPTLPTLPCLETREGAVSVVVPTLDVAAPTVGVDLALPGAEVEARGEAPEVALKMPRLSFPRFGARAKEVAEAKVAKVSPEARVKGPRLRMPTFGLSLLEPRPAAPEVVESKLKLPTIKMPSLGIGVSGPEVKVPKGPEVKLPKAPEVKLPKVPEAALPEVRLPEVELPKVSEMKLPKVPEMAVPEVRLPEVELPKVSEMKLPKVPEMAVPEVRLPEVQLLKVSEMKLPKVPEMAVPEVRLPEVQLPKVSEMKLPEVSEVAVPEVRLPEVQLPKVPEMKVPEMKLPKVPEMKLPEMKLPEVQLPKVPEMAVPDVHLPEVQLPKVPEMKLPEMKLPEVKLPKVPEMAVPDVHLPEVQLPKVPEMKLPKMPEMAVPEVRLPEVQLPKVSEMKLPKVPEMAVPDVHLPEVQLPKVCEMKVPDMKLPEIKLPKVPEMAVPDVHLPEVQLPKVSEIRLPEMQVPKVPDVHLPKAPEVKLPRAPEVQLKATKAEQAEGMEFGFKMPKMTMPKLGRAESPSRGKPGEAGAEVSGKLVTLPCLQPEVDGEAHVGVPSLTLPSVELDLPGALGLQGQVPAAKMGKGERVEGPEVAAGVREVGFRVPSVEIVTPQLPAVEIEEGRLEMIETKVKPSSKFSLPKFGLSGPKVAKAEAEGAGRATKLKVSKFAISLPKARVGAEAEAKGAGEAGLLPALDLSIPQLSLDAHLPSGKVEVAGADLKFKGPRFALPKFGVRGRDTEAAELVPGVAELEGKGWGWDGRVKMPKLKMPSFGLARGKEAEVQGDRASPGEKAESTAVQLKIPEVELVTLGAQEEGRAEGAVAVSGMQLSGLKVSTAGQVVTEGHDAGLRMPPLGISLPQVELTGFGEAGTPGQQAQSTVPSAEGTAGYRVQVPQVTLSLPGAQVAGGELLVGEGVFKMPTVTVPQLELDVGLSREAQAGEAATGEGGLRLKLPTLGARARVGGEGAEEQPPGAERTFCLSLPDVELSPSGGNHAEYQVAEGEGEAGHKLKVRLPRFGLVRAKEGAEEGEKAKSPKLRLPRVGFSQSEMVTGEGSPSPEEEEEEEEEGSGEGASGRRGRVRVRLPRVGLAAPSKASRGQEGDAAPKSPVREKSPKFRFPRVSLSPKARSGSGDQEEGGLRVRLPSVGFSETGAPGPARMEGAQAAAV

SEQ ID NO: 61922 - protein, 3336 aa, Homo sapiens
  Payload ID: 12380
  Gene Symbol: PCNT
  Gene Name: pericentrin
  Uniprot ID: O95613
  ENSP ID: ENSP00000352572
MEVEQEQRRRKVEAGRTKLAHFRQRKTKGDSSHSEKKTAKRKGSAVDASVQEESPVTKEDSALCGGGDICKSTSCDDTPDGAGGAFAAQPEDCDGEKREDLEQLQQKQVNDHPPEQCGMFTVSDHPPEQHGMFTVGDHPPEQRGMFTVSDHPPEQHGMFTVSDHPPEQRGMFTISDHQPEQRGMFTVSDHTPEQRGIFTISDHPAEQRGMFTKECEQECELAITDLESGREDEAGLHQSQAVHGLELEALRLSLSNMHTAQLELTQANLQKEKETALTELREMLNSRRAQELALLQSRQQHELELLREQHAREKEEVVLRCGQEAAELKEKLQSEMEKNAQIVKTLKEDWESEKDLCLENLRKELSAKHQSEMEDLQNQFQKELAEQRAELEKIFQDKNQAERALRNLESHHQAAIEKLREDLQSEHGRCLEDLEFKFKESEKEKQLELENLQASYEDLKAQSQEEIRRLWSQLDSARTSRQELSELHEQLLARTSRVEDLEQLKQREKTQHESELEQLRIYFEKKLRDAEKTYQEDLTLLQQRLQGAREDALLDSVEVGLSCVGLEEKPEKGRKDHVDELEPERHKESLPRFQAELEESHRHQLEALESPLCIQHEGHVSDRCCVETSALGHEWRLEPSEGHSQELPWVHLQGVQDGDLEADTERAARVLGLETEHKVQLSLLQTELKEEIELLKIENRNLYGKLQHETRLKDDLEKVKHNLIEDHQKELNNAKQKTELMKQEFQRKETDWKVMKEELQREAEEKLTLMLLELREKAESEKQTIINKFELREAEMRQLQDQQAAQILDLERSLTEQQGRLQQLEQDLTSDDALHCSQCGREPPTAQDGELAALHVKEDCALQLMLARSRFLEERKEITEKFSAEQDAFLQEAQEQHARELQLLQERHQQQLLSVTAELEARHQAALGELTASLESKQGALLAARVAELQTKHAADLGALETRHLSSLDSLESCYLSEFQTIREEHRQALELLRADFEEQLWKKDSLHQTILTQELEKLKRKHEGELQSVRDHLRTEVSTELAGTVAHELQGVHQGEFGSEKKTALHEKEETLRLQSAQAQPFHQEEKESLSLQLQKKNHQVQQLKDQVLSLSHEIEECRSELEVLQQRRERENREGANLLSMLKADVNLSHSERGALQDALRRLLGLFGETLRAAVTLRSRIGERVGLCLDDAGAGLALSTAPALEETWSDVALPELDRTLSECAEMSSVAEISSHMRESFLMSPESVRECEQPIRRVFQSLSLAVDGLMEMALDSSRQLEEARQIHSRFEKEFSFKNEETAQVVRKHQELLECLKEESAAKAELALELHKTQGTLEGFKVETADLKEVLAGKEDSEHRLVLELESLRRQLQQAAQEQAALREECTRLWSRGEATATDAEAREAALRKEVEDLTKEQSETRKQAEKDRSALLSQMKILESELEEQLSQHRGCAKQAEAVTALEQQVASLDKHLRNQRQFMDEQAAEREHEREEFQQEIQRLEGQLRQAAKPQPWGPRDSQQAPLDGEVELLQQKLREKLDEFNELAIQKESADRQVLMQEEEIKRLEEMNINIRKKVAQLQEEVEKQKNIVKGLEQDKEVLKKQQMSSLLLASTLQSTLDAGRCPEPPSGSPPEGPEIQLEVTQRALLRRESEVLDLKEQLEKMKGDLESKNEEILHLNLKLDMQNSQTAVSLRELEEENTSLKVIYTRSSEIEELKATIENLQENQKRLQKEKAEEIEQLHEVIEKLQHELSLMGPVVHEVSDSQAGSLQSELLCSQAGGPRGQALQGELEAALEAKEALSRLLADQERRHSQALEALQQRLQGAEEAAELQLAELERNVALREAEVEDMASRIQEFEAALKAKEATIAERNLEIDALNQRKAAHSAELEAVLLALARIRRALEQQPLAAGAAPPELQWLRAQCARLSRQLQVLHQRFLRCQVELDRRQARRATAHTRVPGAHPQPRMDGGAKAQVTGDVEASHDAALEPVVPDPQGDLQPVLVTLKDAPLCKQEGVMSVLTVCQRQLQSELLLVKNEMRLSLEDGGKGKEKVLEDCQLPKVDLVAQVKQLQEKLNRLLYSMTFQNVDAADTKSLWPMASAHLLESSWSDDSCDGEEPDISPHIDTCDANTATGGVTDVIKNQAIDACDANTTPGGVTDVIKNWDSLIPDEMPDSPIQEKSECQDMSLSSPTSVLGGSRHQSHTAEAGPRKSPVGMLDLSSWSSPEVLRKDWTLEPWPSLPVTPHSGALSLCSADTSLGDRADTSLPQTQGPGLLCSPGVSAAALALQWAESPPADDHHVQRTAVEKDVEDFITTSFDSQETLSSPPPGLEGKADRSEKSDGSGFGARLSPGSGGPEAQTAGPVTPASISGRFQPLPEAMKEKEVRPKHVKALLQMVRDESHQILALSEGLAPPSGEPHPPRKEDEIQDISLHGGKTQEVPTACPDWRGDLLQVVQEAFEKEQEMQGVELQPRLSGSDLGGHSSLLERLEKIIREQGDLQEKSLEHLRLPDRSSLLSEIQALRAQLRMTHLQNQEKLQHLRTALTSAEARGSQQEHQLRRQVELLAYKVEQEKCIAGDLQKTLSEEQEKANSVQKLLAAEQTVVRDLKSDLCESRQKSEQLSRSLCEVQQEVLQLRSMLSSKENELKAALQELESEQGKGRALQSQLEEEQLRHLQRESQSAKALEELRASLETQRAQSSRLCVALKHEQTAKDNLQKELRIEHSRCEALLAQERSQLSELQKDLAAEKSRTLELSEALRHERLLTEQLSQRTQEACVHQDTQAHHALLQKLKEEKSRVVDLQAMLEKVQQQALHSQQQLEAEAQKHCEALRREKEVSATLKSTVEALHTQKRELRCSLEREREKPAWLQAELEQSHPRLKEQEGRKAARRSAEARQSPAAAEQWRKWQRDKEKLRELELQRQRDLHKIKQLQQTVRDLESKDEVPGSRLHLGSARRAAGSDADHLREQQRELEAMRQRLLSAARLLTSFTSQAVDRTVNDWTSSNEKAVMSLLHTLEELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPGPRARQPQSPPRTRESPPTRDVPSGHTRDPARGRRLAAAASPHSGGRATPSPNSRLERSLTASQDPEHSLTEYIHHLEVIQQRLGGVLPDSTSKKSCHPMIKQ

SEQ ID NO: 61923 - protein, 228 aa, Homo sapiens
  Payload ID: 12380
  Gene Symbol: PCNT
  Gene Name: pericentrin
  ENSP ID: ENSP00000404708
  MOD_RES (1)..(1): Any amino acid
XELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPDSTSKKSCHPMIKQ

SEQ ID NO: 61924 - protein, 2024 aa, Homo sapiens
  Payload ID: 12381
  Gene Symbol: PCM1
  Gene Name: pericentriolar material 1
  Uniprot ID: Q15154
  ENSP ID: ENSP00000327077
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTNPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNMPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNGKETKNRWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 61925 - protein, 1860 aa, Homo sapiens
  Payload ID: 12381
  Gene Symbol: PCM1
  Gene Name: pericentriolar material 1
  ENSP ID: ENSP00000328332
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTNPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNMPPSLADCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNGKETKNRWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIKTGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQEAESGNISQKSDEEDFVKVEDLPLKLTIYSEADLRKKMVEEEQKNHLSGEICEMQTEELAGNSETLKEPETVGAQSI

SEQ ID NO: 61926 - protein, 530 aa, Homo sapiens
  Payload ID: 12381
  Gene Symbol: PCM1
  Gene Name: pericentriolar material 1
  ENSP ID: ENSP00000428123
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTNPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARENEEEDVRTIDSAVGSGSVAESTSLNIDVQSEASDTTARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQ

SEQ ID NO: 61927 - protein, 749 aa, Homo sapiens
  Payload ID: 12381
  Gene Symbol: PCM1
  Gene Name: pericentriolar material 1
  ENSP ID: ENSP00000428131
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTNPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARENEEEDVRTIDSAVGSGSVAESTSLNIDVQSEASDTTARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNMPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNS

SEQ ID NO: 61928 - protein, 764 aa, Homo sapiens
  Payload ID: 12381
  Gene Symbol: PCM1
  Gene Name: pericentriolar material 1
  ENSP ID: ENSP00000429054
  MOD_RES (1)..(1): Any amino acid
XKASAQASLASKDKTPKSKSKKRNSTQLKSRVKNIRYESASMSSTCEPCKSRNRHSAQTEEPVQAKVFSRKNHEQLEKIIKCNRSTEISSAHARRILQQSNRNACNEAPETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 61929 - protein, 408 aa, Homo sapiens
  Payload ID: 12381
  Gene Symbol: PCM1
  Gene Name: pericentriolar material 1
  ENSP ID: ENSP00000429941
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTNPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQ

SEQ ID NO: 61930 - protein, 1860 aa, Homo sapiens; identical to SEQ ID NO: 61925
  Payload ID: 12381
  Gene Symbol: PCM1
  Gene Name: pericentriolar material 1
  ENSP ID: ENSP00000430521

SEQ ID NO: 61931 - protein, 2016 aa, Homo sapiens
  Payload ID: 12381
  Gene Symbol: PCM1
  Gene Name: pericentriolar material 1
  ENSP ID: ENSP00000431099
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTNPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNMPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNGKETKNRWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 61932 - protein, 522 aa, Homo sapiens
  Payload ID: 12382
  Gene Symbol: PLIN1
  Gene Name: perilipin 1
  Uniprot ID: O60240
  ENSP ID: ENSP00000300055
MAVNKGLTLLDGDLPEQENVLQRVLQLPVVSGTCECFQKTYTSTKEAHPLVASVCNAYEKGVQSASSLAAWSMEPVVRRLSTQFTAANELACRGLDHLEEKIPALQYPPEKIASELKDTISTRLRSARNSISVPIASTSDKVLGAALAGCELAWGVARDTAEFAANTRAGRLASGGADLALGSIEKVVEYLLPPDKEESAPAPGHQQAQKSPKAKPSLLSRVGALTNTLSRYTVQTMARALEQGHTVAMWIPGVVPLSSLAQWGASVAMQAVSRRRSEVRVPWLHSLAAAQEEDHEDQTDTEGEDTEEEEELETEENKFSEVAALPGPRGLLGGVAHTLQKTLQTTISAVTWAPAAVLGMAGRVLHLTPAPAVSSTKGRAMSLSDALKGVTDNVVDTVVHYVPLPRLSLMEPESEFRDIDNPPAEVERREAERRASGAPSAGPEPAPRLAQPRRSLRSAQSPGAPPGPGLEDEVATPAAPRPGFPAVPREKPKRRVSDSFFRPSVMEPILGRTHYSQLRKKS

SEQ ID NO: 61933 - protein, 522 aa, Homo sapiens; identical to SEQ ID NO: 61932
  Payload ID: 12382
  Gene Symbol: PLIN1
  Gene Name: perilipin 1
  Uniprot ID: O60240
  ENSP ID: ENSP00000402167

SEQ ID NO: 61934 - protein, 73 aa, Homo sapiens
  Payload ID: 12382
  Gene Symbol: PLIN1
  Gene Name: perilipin 1
  ENSP ID: ENSP00000453426
EEELETEENKFSEVAALPGPRGLLGGVAHTLQKTLQTTISALLAHSHISICIITAFTCIVTLLMLGNQNGDDI

SEQ ID NO: 61935 - protein, 437 aa, Homo sapiens
  Payload ID: 12383
  Gene Symbol: PLIN2
  Gene Name: perilipin 2
  Uniprot ID: Q99541
  ENSP ID: ENSP00000276914
MASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQIVANAKGAVTGAKDAVTTTVTGAKDSVASTITGVMDKTKGAVTGSVEKTKSVVSGSINTVLGSRMMQLVSSGVENALTKSELLVEQYLPLTEEELEKEAKKVEGFDLVQKPSYYVRLGSLSTKLHSRAYQQALSRVKEAKQKSQQTISQLHSTVHLIEFARKNVYSANQKIQDAQDKLYLSWVEWKRSIGYDDTDESHCAEHIESRTLAIARNLTQQLQTTCHTLLSNIQGVPQNIQDQAKHMGVMAGDIYSVFRNAASFKEVSDSLLTSSKGQLQKMKESLDDVMDYLVNNTPLNWLVGPFYPQLTESQNAQDQGAEMDKSSQETQRSEHKTH

SEQ ID NO: 61936 - protein, 110 aa, Homo sapiens
  Payload ID: 12383
  Gene Symbol: PLIN2
  Gene Name: perilipin 2
  ENSP ID: ENSP00000369831
MASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQVSLGQKC

SEQ ID NO: 61937 - protein, 126 aa, Homo sapiens
  Payload ID: 12383
  Gene Symbol: PLIN2
  Gene Name: perilipin 2
  ENSP ID: ENSP00000369832
MASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQANTCFPNLDLDVCLKNNGHFLTS

SEQ ID NO: 61938 - protein, 125 aa, Homo sapiens
  Payload ID: 12383
  Gene Symbol: PLIN2
  Gene Name: perilipin 2
  ENSP ID: ENSP00000403421
MASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQIVANAKGAVTGAKDAVTTTVTG

SEQ ID NO: 61939 - protein, 434 aa, Homo sapiens
  Payload ID: 12384
  Gene Symbol: PLIN3
  Gene Name: perilipin 3
  Uniprot ID: O60664
  ENSP ID: ENSP00000221957
MSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQVLSLMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 61940 - protein, 35 aa, Homo sapiens
  Payload ID: 12384
  Gene Symbol: PLIN3
  Gene Name: perilipin 3
  ENSP ID: ENSP00000465117
MSADGAEADGSTQVTVEEPVQQPSVVDRVASMPLI

SEQ ID NO: 61941 - protein, 433 aa, Homo sapiens
  Payload ID: 12384
  Gene Symbol: PLIN3
  Gene Name: perilipin 3
  Uniprot ID: O60664
  ENSP ID: ENSP00000465596
MSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQVLSLMETVKQGVDQKLVEGQEKLHQMWLSWNQKQLQGPEKEPPKPEVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 61942 - protein, 172 aa, Homo sapiens
  Payload ID: 12384
  Gene Symbol: PLIN3
  Gene Name: perilipin 3
  ENSP ID: ENSP00000465975
MPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNH

SEQ ID NO: 61943 - protein, 422 aa, Homo sapiens
  Payload ID: 12384
  Gene Symbol: PLIN3
  Gene Name: perilipin 3
  Uniprot ID: O60664
  ENSP ID: ENSP00000467803
MSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQVLSLMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 61944 - protein, 168 aa, Homo sapiens
  Payload ID: 12384
  Gene Symbol: PLIN3
  Gene Name: perilipin 3
  ENSP ID: ENSP00000468096
MAGSGLELPFWSQRQASAAETMSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQL

SEQ ID NO: 61945 - protein, 292 aa, Homo sapiens
  Payload ID: 12384
  Gene Symbol: PLIN3
  Gene Name: perilipin 3
  ENSP ID: ENSP00000468476
  MOD_RES (1)..(1): Any amino acid
XKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 61946 - protein, 1357 aa, Homo sapiens
  Payload ID: 12385
  Gene Symbol: PLIN4
  Gene Name: perilipin 4
  Uniprot ID: Q96Q06
  ENSP ID: ENSP00000301286
MQTLGSFFGSLPGFSSARNLVANAHSSARARPAADPTGAPAAEAAQPQAQVAAHPEQTAPWTEKELQPSEKQMVSGAKDLVCSKMSRAKDAVSSGVASVVDVAKGVVQGGLDTTRSALTGTKEVVSSGVTGAMDMAKGAVQGGLDTSKAVLTGTKDTVSTGLTGAVNVAKGTVQAGVDTTKTVLTGTKDTVTTGVMGAVNLAKGTVQTGVETSKAVLTGTKDAVSTGLTGAVNVARGSIQTGVDTSKTVLTGTKDTVCSGVTGAMNVAKGTIQTGVDTSKTVLTGTKDTVCSGVTGAMNVAKGTIQTGVDTSKTVLTGTKDTVCSGVTGAMNVAKGTIQTGVDTTKTVLTGTKNTVCSGVTGAVNLAKEAIQGGLDTTKSMVMGTKDTMSTGLTGAANVAKGAMQTGLNTTQNIATGTKDTVCSGVTGAMNLARGTIQTGVDTTKIVLTGTKDTVCSGVTGAANVAKGAVQGGLDTTKSVLTGTKDAVSTGLTGAVNVAKGTVQTGVDTTKTVLTGTKDTVCSGVTSAVNVAKGAVQGGLDTTKSVVIGTKDTMSTGLTGAANVAKGAVQTGVDTAKTVLTGTKDTVTTGLVGAVNVAKGTVQTGMDTTKTVLTGTKDTIYSGVTSAVNVAKGAVQTGLKTTQNIATGTKNTFGSGVTSAVNVAKGAAQTGVDTAKTVLTGTKDTVTTGLMGAVNVAKGTVQTSVDTTKTVLTGTKDTVCSGVTGAANVAKGAIQGGLDTTKSVLTGTKDAVSTGLTGAVKLAKGTVQTGMDTTKTVLTGTKDAVCSGVTGAANVAKGAVQMGVDTAKTVLTGTKDTVCSGVTGAANVAKGAVQTGLKTTQNIATGTKNTLGSGVTGAAKVAKGAVQGGLDTTKSVLTGTKDAVSTGLTGAVNLAKGTVQTGVDTSKTVLTGTKDTVCSGVTGAVNVAKGTVQTGVDTAKTVLSGAKDAVTTGVTGAVNVAKGTVQTGVDASKAVLMGTKDTVFSGVTGAMSMAKGAVQGGLDTTKTVLTGTKDAVSAGLMGSGNVATGATHTGLSTFQNWLPSTPATSWGGLTSSRTTDNGGEQTALSPQEAPFSGISTPPDVLSVGPEPAWEAAATTKGLATDVATFTQGAAPGREDTGLLATTHGPEEAPRLAMLQNELEGLGDIFHPMNAEEQAQLAASQPGPKVLSAEQGSYFVRLGDLGPSFRQRAFEHAVSHLQHGQFQARDTLAQLQDCFRLIEKAQQAPEGQPRLDQGSGASAEDAAVQEERDAGVLSRVCGLLRQLHTAYSGLVSSLQGLPAELQQPVGRARHSLCELYGIVASAGSVEELPAERLVQSREGVHQAWQGLEQLLEGLQHNPPLSWLVGPFALPAGGQ

SEQ ID NO: 61947 - protein, 1372 aa, Homo sapiens
  Payload ID: 12385
  Gene Symbol: PLIN4
  Gene Name: perilipin 4
  ENSP ID: ENSP00000488481
MSAPDEGRRDPPKPKGKTLGSFFGSLPGFSSARNLVANAHSSARARPAADPTGAPAAEAAQPQAQVAAHPEQTAPWTEKELQPSEKQMVSGAKDLVCSKMSRAKDAVSSGVASVVDVAKGVVQGGLDTTRSALTGTKEVVSSGVTGAMDMAKGAVQGGLDTSKAVLTGTKDTVSTGLTGAVNVAKGTVQAGVDTTKTVLTGTKDTVTTGVMGAVNLAKGTVQTGVETSKAVLTGTKDAVSTGLTGAVNVARGSIQTGVDTSKTVLTGTKDTVCSGVTGAMNVAKGTIQTGVDTSKTVLTGTKDTVCSGVTGAMNVAKGTIQTGVDTSKTVLTGTKDTVCSGVTGAMNVAKGTIQTGVDTTKTVLTGTKNTVCSGVTGAVNLAKEAIQGGLDTTKSMVMGTKDTMSTGLTGAANVAKGAMQTGLNTTQNIATGTKDTVCSGVTGAMNLARGTIQTGVDTTKIVLTGTKDTVCSGVTGAANVAKGAVQGGLDTTKSVLTGTKDAVSTGLTGAVNVAKGTVQTGVDTTKTVLTGTKDTVCSGVTSAVNVAKGAVQGGLDTTKSVVIGTKDTMSTGLTGAANVAKGAVQTGVDTAKTVLTGTKDTVTTGLVGAVNVAKGTVQTGMDTTKTVLTGTKDTIYSGVTSAVNVAKGAVQTGLKTTQNIATGTKNTFGSGVTSAVNVAKGAAQTGVDTAKTVLTGTKDTVTTGLMGAVNVAKGTVQTSVDTTKTVLTGTKDTVCSGVTGAANVAKGAIQGGLDTTKSVLTGTKDAVSTGLTGAVKLAKGTVQTGMDTTKTVLTGTKDAVCSGVTGAANVAKGAVQMGVDTAKTVLTGTKDTVCSGVTGAANVAKGAVQTGLKTTQNIATGTKNTLGSGVTGAAKVAKGAVQGGLDTTKSVLTGTKDAVSTGLTGAVNLAKGTVQTGVDTSKTVLTGTKDTVCSGVTGAVNVAKGTVQTGVDTAKTVLSGAKDAVTTGVTGAVNVAKGTVQTGVDASKAVLMGTKDTVFSGVTGAMSMAKGAVQGGLDTTKTVLTGTKDAVSAGLMGSGNVATGATHTGLSTFQNWLPSTPATSWGGLTSSRTTDNGGEQTALSPQEAPFSGISTPPDVLSVGPEPAWEAAATTKGLATDVATFTQGAAPGREDTGLLATTHGPEEAPRLAMLQNELEGLGDIFHPMNAEEQAQLAASQPGPKVLSAEQGSYFVRLGDLGPSFRQRAFEHAVSHLQHGQFQARDTLAQLQDCFRLIEKAQQAPEGQPRLDQGSGASAEDAAVQEERDAGVLSRVCGLLRQLHTAYSGLVSSLQGLPAELQQPVGRARHSLCELYGIVASAGSVEELPAERLVQSREGVHQAWQGLEQLLEGLQHNPPLSWLVGPFALPAGGQ

SEQ ID NO: 61948 - protein, 463 aa, Homo sapiens
  Payload ID: 12386
  Gene Symbol: PLIN5
  Gene Name: perilipin 5
  Uniprot ID: Q00G26
  ENSP ID: ENSP00000371272
MSEEEAAQIPRSSVWEQDQQNVVQRVVALPLVRATCTAVCDVYSAAKDRHPLLGSACRLAENCVCGLTTRALDHAQPLLEHLQPQLATMNSLACRGLDKLEEKLPFLQQPSETVVTSAKDVVASSVTGVVDLARRGRRWSVELKRSVSHAVDVVLEKSEELVDHFLPMTEEELAALAAEAEGPEVGSVEDQRRQQGYFVRLGSLSARIRHLAYEHSVGKLRQSKHRAQDTLAQLQETLELIDHMQCGVTPTAPACPGKVHELWGEWGQRPPESRRRSQAELETLVLSRSLTQELQGTVEALESSVRGLPAGAQEKVAEVRRSVDALQTAFADARCFRDVPAAALAEGRGRVAHAHACVDELLELVVQAVPLPWLVGPFAPILVERPEPLPDLADLVDEVIGGPDPRWAHLDWPAQQRAWEAEHRDGSGNGDGDRMGVAGDICEQEPETPSCPVKHTLMPELDF

SEQ ID NO: 61949 - protein, 58 aa, Homo sapiens
  Payload ID: 12386
  Gene Symbol: PLIN5
  Gene Name: perilipin 5
  ENSP ID: ENSP00000464926
MSEEEAAQIPRSSVWEQDQQVRAAPPMEQGQKVLCGTVPSRSVSGQVSRPTPLLAGKT

SEQ ID NO: 61950 - protein, 58 aa, Homo sapiens; identical to SEQ ID NO: 61949
  Payload ID: 12386
  Gene Symbol: PLIN5
  Gene Name: perilipin 5
  ENSP ID: ENSP00000468027

SEQ ID NO: 61951 - protein, 1290 aa, Homo sapiens
  Payload ID: 12387
  Gene Symbol: PER1
  Gene Name: period circadian clock 1
  Uniprot ID: O15534
  ENSP ID: ENSP00000314420
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGCHHGPAPPSRRHHCRSKAKRSRHHQNPRAEAPCYVSHPSPVPPSTPWPTPPATTPFPAVVQPYPLPVFSPRGGPQPLPPAPTSVPPAAFPAPLVTPMVALVLPNYLFPTPSSYPYGALQTPAEGPPTPASHSPSPSLPALAPSPPHRPDSPLFNSRCSSPLQLNLLQLEELPRAEGAAVAGGPGSSAGPPPPSAEAAEPEARLAEVTESSNQDALSGSSDLLELLLQEDSRSGTGSAASGSLGSGLGSGSGSGSHEGGSTSASITRSSQSSHTSKYFGSIDSSEAEAGAARGGAEPGDQVIKYVLQDPIWLLMANADQRVMMTYQVPSRDMTSVLKQDRERLRAMQKQQPRFSEDQRRELGAVHSWVRKGQLPRALDVMACVDCGSSTQDPGHPDDPLFSELDGLGLEPMEEGGGEQGSSGGGSGEGEGCEEAQGGAKASSSQDLAMEEEEEGRSSSSPALPTAGNCTS

SEQ ID NO: 61952 - protein, 859 aa, Homo sapiens
  Payload ID: 12387
  Gene Symbol: PER1
  Gene Name: period circadian clock 1
  Uniprot ID: O15534
  ENSP ID: ENSP00000346979
MLEVLEEIWSVRARRAHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGSHLGPPGACPLPSLGLDCWGVGLKGGVSAPGTQAGVASTTRPCLGTGPSLASPH

SEQ ID NO: 61953 - protein, 1267 aa, Homo sapiens
  Payload ID: 12387
  Gene Symbol: PER1
  Gene Name: period circadian clock 1
  ENSP ID: ENSP00000462064
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGCHHGPAPPSRRHHCRSKAKRSRHHQNPRAEAPCYVSHPSPVPPSTPWPTPPATTPFPAVVQPYPLPVFSPRGGPQPLPPAPTSVPPAAFPAPLVTPMVALVLPNYLFPTPSSYPYGALQTPAEGPPTPASHSPSPSLPALAPSPPHRPDSPLFNSRCSSPLQLNLLQLEELPRAEGAAVAGGPGSSAGPPPPSAEAAEPEARLAEVTESSNQDALSGSSDLLELLLQEDSRSGTGSAASGSLGSGLGSGSGSGSHEGGSTSASITRSSQSSHTSKYFGSIDSSEAEAGAARGGAEPGDQVIKYVLQDPIWLLMANADQRVMMTYQVPSRDMTSVLKQDRERLRAMQKQQPRFSEDQRRELGAVHSWVRKGQLPRALDVMACVDCGSSTQDPGHPDDPLFSELDGLGLEPMEEGGGEQGSSGGGSGEGEGCEEAQGGAKASSSQDLAMEEEEEGRSSSSPALPTAGNCTS

SEQ ID NO: 61954 - protein, 117 aa, Homo sapiens
  Payload ID: 12387
  Gene Symbol: PER1
  Gene Name: period circadian clock 1
  ENSP ID: ENSP00000462546
MSGPLEGADGGGDPRPGESFCPGGVPSPGPPQHRPCPGPSLADDTDANSNGSSGNESNGHESRGASQRSSHSSSSGNGKDSALLETTESSKSSEQSARARTQKELMTALRELKLRLP

SEQ ID NO: 61955 - protein, 824 aa, Homo sapiens
  Payload ID: 12387
  Gene Symbol: PER1
  Gene Name: period circadian clock 1
  ENSP ID: ENSP00000463054
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGGGH

SEQ ID NO: 61956 - protein, 168 aa, Homo sapiens
  Payload ID: 12387
  Gene Symbol: PER1
  Gene Name: period circadian clock 1
  ENSP ID: ENSP00000463369
VTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGRIRPRWAGGMPRLAVPTGVWRTRAICPCVHGLTLLPPSASMPPSSAHPQLDPSCNLSLALFLSQ

SEQ ID NO: 61957 - protein, 175 aa, Homo sapiens
  Payload ID: 12387
  Gene Symbol: PER1
  Gene Name: period circadian clock 1
  ENSP ID: ENSP00000463385
MQPASPPARWSFHSAAGWSGGGQACGGHSCDQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQV

SEQ ID NO: 61958 - protein, 112 aa, Homo sapiens
  Payload ID: 12387
  Gene Symbol: PER1
  Gene Name: period circadian clock 1
  ENSP ID: ENSP00000463661
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSA

SEQ ID NO: 61959 - protein, 572 aa, Homo sapiens
  Payload ID: 12387
  Gene Symbol: PER1
  Gene Name: period circadian clock 1
  ENSP ID: ENSP00000464696
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPLQARSRPRPFPANPQTQSWRRVLLPSRPH

SEQ ID NO: 61960 - protein, 1255 aa, Homo sapiens
  Payload ID: 12388
  Gene Symbol: PER2
  Gene Name: period circadian clock 2
  Uniprot ID: O15055
  ENSP ID: ENSP00000254657
MNGYAEFPPSPSNPTKEPVEPQPSQVPLQEDVDMSSGSSGHETNENCSTGRDSQGSDCDDSGKELGMLVEPPDARQSPDTFSLMMAKSEHNPSTSGCSSDQSSKVDTHKELIKTLKELKVHLPADKKAKGKASTLATLKYALRSVKQVKANEEYYQLLMSSEGHPCGADVPSYTVEEMESVTSEHIVKNADMFAVAVSLVSGKILYISDQVASIFHCKRDAFSDAKFVEFLAPHDVGVFHSFTSPYKLPLWSMCSGADSFTQECMEEKSFFCRVSVRKSHENEIRYHPFRMTPYLVKVRDQQGAESQLCCLLLAERVHSGYEAPRIPPEKRIFTTTHTPNCLFQDVDERAVPLLGYLPQDLIETPVLVQLHPSDRPLMLAIHKKILQSGGQPFDYSPIRFRARNGEYITLDTSWSSFINPWSRKISFIIGRHKVRVGPLNEDVFAAHPCTEEKALHPSIQELTEQIHRLLLQPVPHSGSSGYGSLGSNGSHEHLMSQTSSSDSNGHEDSRRRRAEICKNGNKTKNRSHYSHESGEQKKKSVTEMQTNPPAEKKAVPAMEKDSLGVSFPEELACKNQPTCSYQQISCLDSVIRYLESCNEAATLKRKCEFPANVPALRSSDKRKATVSPGPHAGEAEPPSRVNSRTGVGTHLTSLALPGKAESVASLTSQCSYSSTIVHVGDKKPQPELEMVEDAASGPESLDCLAGPALACGLSQEKEPFKKLGLTKEVLAAHTQKEEQSFLQKFKEIRKLSIFQSHCHYYLQERSKGQPSERTAPGLRNTSGIDSPWKKTGKNRKLKSKRVKPRDSSESTGSGGPVSARPPLVGLNATAWSPSDTSQSSCPAVPFPAPVPAAYSLPVFPAPGTVAAPPAPPHASFTVPAVPVDLQHQFAVQPPPFPAPLAPVMAFMLPSYSFPSGTPNLPQAFFPSQPQFPSHPTLTSEMASASQPEFPSRTSIPRQPCACPATRATPPSAMGRASPPLFQSRSSSPLQLNLLQLEEAPEGGTGAMGTTGATETAAVGADCKPGTSRDQQPKAPLTRDEPSDTQNSDALSTSSGLLNLLLNEDLCSASGSAASESLGSGSLGCDASPSGAGSSDTSHTSKYFGSIDSSENNHKAKMNTGMEESEHFIKCVLQDPIWLLMADADSSVMMTYQLPSRNLEAVLKEDREKLKLLQKLQPRFTESQKQELREVHQWMQTGGLPAAIDVAECVYCENKEKGNICIPYEEDIPSLGLSEVSDTKEDENGSPLNHRIEEQT

SEQ ID NO: 61961 - protein, 404 aa, Homo sapiens
  Payload ID: 12388
  Gene Symbol: PER2
  Gene Name: period circadian clock 2
  Uniprot ID: O15055
  ENSP ID: ENSP00000348013
MNGYAEFPPSPSNPTKEPVEPQPSQVPLQEDVDMSSGSSGHETNENCSTGRDSQGSDCDDSGKELGMLVEPPDARQSPDTFSLMMAKSEHNPSTSGCSSDQSSKVDTHKELIKTLKELKVHLPADKKAKGKASTLATLKYALRSVKQVKANEEYYQLLMSSEGHPCGADVPSYTVEEMESVTSEHIVKNADMFAVAVSLVSGKILYISDQVASIFHCKRDAFSDAKFVEFLAPHDVGVFHSFTSPYKLPLWSMCSGADSFTQECMEEKSFFCRVSVRKSHENEIRYHPFRMTPYLVKVRDQQGAESQLCCLLLAERVHSGYEAPRIPPEKRIFTTTHTPNCLFQDVDESPAVRRAAFRLFSHSVSRPERRVHHVGHQLVQLHQPMEQENLLHHWEAQSQGGPFE

SEQ ID NO: 61962 - protein, 109 aa, Homo sapiens
  Payload ID: 12388
  Gene Symbol: PER2
  Gene Name: period circadian clock 2
  ENSP ID: ENSP00000405891
MNGYAEFPPSPSNPTKEPVEPQPSQVPLQEDVDMSSGSSGHETNENCSTGRDSQGSDCDDSGKELGMLVEPPDARQSPDTFSLMMAKSEHNPSTSGCSSDQSSKVDTHK

SEQ ID NO: 61963 - protein, 1201 aa, Homo sapiens
  Payload ID: 12389
  Gene Symbol: PER3
  Gene Name: period circadian clock 3
  Uniprot ID: P56645
  ENSP ID: ENSP00000355031
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTDTFVAVFSFLSGRLVHISEQAALILNRKKDVLASSHFVDLLAPQDMRVFYAHTARAQLPFWNNWTQRAARYECAPVKPFFCRIRGGEDRKQEKCHSPFRIIPYLIHVHHPAQPELESEPCCLTVVEKIHSGYEAPRIPVNKRIFTTTHTPGCVFLEVDEKAVPLLGYLPQDLIGTSILSYLHPEDRSLMVAIHQKVLKYAGHPPFEHSPIRFCTQNGDYIILDSSWSSFVNPWSRKISFIIGRHKVRTSPLNEDVFATKIKKMNDNDKDITELQEQIYKLLLQPVHVSVSSGYGSLGSSGSQEQLVSIASSSEASGHRVEETKAEQMTLQQVYASVNKIKNLGQQLYIESMTKSSFKPVTGTRTEPNGGGECKTFTSFHQTLKNNSVYTEPCEDLRNDEHSPSYQQINCIDSVIRYLKSYNIPALKRKCISCTNTTSSSSEEDKQNHKADDVQALQAGLQIPAIPKSEMPTNGRSIDTGGGAPQILSTAMLSLGSGISQCGYSSTIVHVPPPETARDATLFCEPWTLNMQPAPLTSEEFKHVGLTAAVLSAHTQKEEQNYVDKFREKILSSPYSSYLQQESRSKAKYSYFQGDSTSKQTRSAGCRKGKHKRKKLPEPPDSSSSNTGSGPRRGAHQNAQPCCPSAASSPHTSSPTFPPAAMVPSQAPYLVPAFPLPAATSPGREYAAPGTAPEGLHGLPLSEGLQPYPAFPFPYLDTFMTVFLPDPPVCPLLSPSFLPCPFLGATASSAISPSMSSAMSPTLDPPPSVTSQRREEEKWEAQSEGHPFITSRSSSPLQLNLLQEEMPRPSESPDQMRRNTCPQTEYCVTGNNGSESSPATTGALSTGSPPRENPSHPTASALSTGSPPMKNPSHPTASALSTGSPPMKNPSHPTASTLSMGLPPSRTPSHPTATVLSTGSPPSESPSRTGSAASGSSDSSIYLTSSVYSSKISQNGQQSQDVQKKETFPNVAEEPIWRMIRQTPERILMTYQVPERVKEVVLKEDLEKLESMRQQQPQFSHGQKEELAKVYNWIQSQTVTQEIDIQACVTCENEDSADGAATSCGQVLVEDSC

SEQ ID NO: 61964 - protein, 1210 aa, Homo sapiens
  Payload ID: 12389
  Gene Symbol: PER3
  Gene Name: period circadian clock 3
  Uniprot ID: P56645
  ENSP ID: ENSP00000366755
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTDTFVAVFSFLSGRLVHISEQAALILNRKKDVLASSHFVDLLAPQDMRVFYAHTARAQLPFWNNWTQRAAARYECAPVKPFFCRIRGGEDRKQEKCHSPFRIIPYLIHVHHPAQPELESEPCCLTVVEKIHSGYEAPRIPVNKRIFTTTHTPGCVFLEVDEKAVPLLGYLPQDLIGTSILSYLHPEDRSLMVAIHQKVLKYAGHPPFEHSPIRFCTQNGDYIILDSSWSSFVNPWSRKISFIIGRHKVRTSPLNEDVFATKIKKMNDNDKDITELQEQIYKLLLQPVHVSVSSGYGSLGSSGSQEQLVSIASSSEASGHRVEETKAEQMTLQQVYASVNKIKNLGQQLYIESMTKSSFKPVTGTRTEPNGGGESANGGGECKTFTSFHQTLKNNSVYTEPCEDLRNDEHSPSYQQINCIDSVIRYLKSYNIPALKRKCISCTNTTSSSSEEDKQNHKADDVQALQAGLQIPAIPKSEMPTNGRSIDTGGGAPQILSTAMLSLGSGISQCGYSSTIVHVPPPETARDATLFCEPWTLNMQPAPLTSEEFKHVGLTAAVLSAHTQKEEQNYVDKFREKILSSPYSSYLQQESRSKAKYSYFQGDSTSKQTRSAGCRKGKHKRKKLPEPPDSSSSNTGSGPRRGAHQNAQPCCPSAASSPHTSSPTFPPAAMVPSQAPYLVPAFPLPAATSPGREYAAPGTAPEGLHGLPLSEGLQPYPAFPFPYLDTFMTVFLPDPPVCPLLSPSFLPCPFLGATASSAISPSMSSAMSPTLDPPPSVTSQRREEEKWEAQSEGHPFITSRSSSPLQLNLLQEEMPRPSESPDQMRRNTCPQTEYQCVTGNNGSESSPATTGALSTGSPPRENPSHPTASALSTGSPPMKNPSHPTASALSTGSPPMKNPSHPTASTLSMGLPPSRTPSHPTATVLSTGSPPSESPSRTGSAASGSSDSSIYLTSSVYSSKISQNGQQSQDVQKKETFPNVAEEPIWRMIRQTPERILMTYQVPERVKEVVLKEDLEKLESMRQQQPQFSHGQKEELAKVYNWIQSQTVTQEIDIQACVTCENEDSADGAATSCGQVLVEDSC

SEQ ID NO: 61965 - protein, 378 aa, Homo sapiens
  Payload ID: 12389
  Gene Symbol: PER3
  Gene Name: period circadian clock 3
  ENSP ID: ENSP00000366764
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTDTFVAVFSFLSGRLVHISEQAALILNRKKDVLASSHFVDLLAPQDMRVFYAHTARAQLPFWNNWTQRAARYECAPVKPFFCRIRGGEDRKQEKCHSPFRIIPYLIHVHHPAQPELESEPCCLTVVEKIHSGYEAPRIPVNKRIFTTTHTPGCVFLEVDEKAVPLLGYLPQDLIGTSILSYLHPEDRSLMVAIHQKVLKYAGHPPFEHSPIRFCTQNGDYIILDSSWSSFVNPWSRKISFIIGRHKVRT

SEQ ID NO: 61966 - protein, 1191 aa, Homo sapiens
  Payload ID: 12389
  Gene Symbol: PER3
  Gene Name: period circadian clock 3
  ENSP ID: ENSP00000479223
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTDTFVAVFSFLSGRLVHISEQAALILNRKKDVLASSHFVDLLAPQDMRVFYAHTARAQLPFWNNWTQRAAARYECAPVKPFFCRIRGGEDRKQEKCHSPFRIIPYLIHVHHPAQPELESEPCCLTVVEKIHSGYEAPRIPVNKRIFTTTHTPGCVFLEVDEKAVPLLGYLPQDLIGTSILSYLHPEDRSLMVAIHQKVLKYAGHPPFEHSPIRFCTQNGDYIILDSSWSSFVNPWSRKISFIIGRHKVRTSPLNEDVFATKIKKMNDNDKDITELQEQIYKLLLQPVHVSVSSGYGSLGSSGSQEQLVSIASSSEASGHRVEETKAEQMTLQQVYASVNKIKNLGQQLYIESMTKSSFKPVTGTRTEPNGGGESANGGGECKTFTSFHQTLKNNSVYTEPCEDLRNDEHSPSYQQINCIDSVIRYLKSYNIPALKRKCISCTNTTSSSSEEDKQNHKADDVQALQAGLQIPAIPKSEMPTNGRSIDTGGGAPQILSTAMLSLGSGISQCGYSSTIVHVPPPETARDATLFCEPWTLNMQPAPLTSEEFKHVGLTAAVLSAHTQKEEQNYVDKFREKILSSPYSSYLQQESRSKAKYSYFQGDSTSKQTRSAGCRKGKHKRKKLPEPPDSSSSNTGSGPRRGAHQNAQPCCPSAASSPHTSSPTFPPAAMVPSQAPYLVPAFPLPAATSPGREYAAPGTAPEGLHGLPLSEGLQPYPAFPFPYLDTFMTVFLPDPPVCPLLSPSFLPCPFLGATASSAISPSMSSAMSPTLDPPPSVTSQRREEEKWEAQSEGHPFITSRSSSPLQLNLLQEEMPRPSESPDQMRRNTCPQTEYCVTGNNGSESSPATTGALSTGSPPRENPSHPTASALSTGSPPMKNPSHPTASTLSMGLPPSRTPSHPTATVLSTGSPPSESPSRTGSAASGSSDSSIYLTSSVYSSKISQNGQQSQDVQKKETFPNVAEEPIWRMIRQTPERILMTYQVPERVKEVVLKEDLEKLESMRQQQPQFSHGQKEELAKVYNWIQSQTVTQEIDIQACVTCENEDSADGAATSCGQVLVEDSC

SEQ ID NO: 61967 - protein, 1210 aa, Homo sapiens; identical to SEQ ID NO: 61964
  Payload ID: 12389
  Gene Symbol: PER3
  Gene Name: period circadian clock 3
  Uniprot ID: P56645
  ENSP ID: ENSP00000482093

SEQ ID NO: 61968 - protein, 779 aa, Homo sapiens
  Payload ID: 12390
  Gene Symbol: POSTN
  Gene Name: periostin, osteoblast specific factor
  Uniprot ID: Q15063
  ENSP ID: ENSP00000369066
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYKPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 61969 - protein, 809 aa, Homo sapiens
  Payload ID: 12390
  Gene Symbol: POSTN
  Gene Name: periostin, osteoblast specific factor
  Uniprot ID: Q15063
  ENSP ID: ENSP00000369067
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 61970 - protein, 836 aa, Homo sapiens
  Payload ID: 12390
  Gene Symbol: POSTN
  Gene Name: periostin, osteoblast specific factor
  Uniprot ID: Q15063
  ENSP ID: ENSP00000369071
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYTTKIITKVVEPKIKVIEGSLQPIIKTEGPTLTKVKIEGEPEFRLIKEGETITEVIHGEPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 61971 - protein, 808 aa, Homo sapiens
  Payload ID: 12390
  Gene Symbol: POSTN
  Gene Name: periostin, osteoblast specific factor
  ENSP ID: ENSP00000369073
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYTTKIITKVVEPKIKVIEGSLQPIIKTEGPTLTKVKIEGEPEFRLIKEGETITEVIHGEPIIKKYTKIIDGVPVEITEKETREERIITGPEIKYTRISTGGGETEETLKKLLQEDTPVRKLQANKKVQGSRRRLREGRSQ

SEQ ID NO: 61972 - protein, 749 aa, Homo sapiens
  Payload ID: 12390
  Gene Symbol: POSTN
  Gene Name: periostin, osteoblast specific factor
  Uniprot ID: Q15063
  ENSP ID: ENSP00000437953
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYSPEIKYTRISTGGGETEETLKKLLQEEVTKVTKFIEGGDGHLFEDEEIKRLLQGDTPVRKLQANKKVQGSRRRLREGRSQ

SEQ ID NO: 61973 - protein, 781 aa, Homo sapiens
  Payload ID: 12390
  Gene Symbol: POSTN
  Gene Name: periostin, osteoblast specific factor
  Uniprot ID: Q15063
  ENSP ID: ENSP00000437959
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVEITEKETREERIITGPEIKYTRISTGGGETEETLKKLLQEDTPVRKLQANKKVQGSRRRLREGRSQ

SEQ ID NO: 61974 - protein, 132 aa, Homo sapiens
  Payload ID: 12391
  Gene Symbol: PMP2
  Gene Name: peripheral myelin protein 2
  Uniprot ID: P02689
  ENSP ID: ENSP00000256103
MSNKFLGTWKLVSSENFDDYMKALGVGLATRKLGNLAKPTVIISKKGDIITIRTESTFKNTEISFKLGQEFEETTADNRKTKSIVTLQRGSLNQVQRWDGKETTIKRKLVNGKMVAECKMKGVVCTRIYEKV

SEQ ID NO: 61975 - protein, 60 aa, Homo sapiens
  Payload ID: 12391
  Gene Symbol: PMP2
  Gene Name: peripheral myelin protein 2
  ENSP ID: ENSP00000429917
MSNKFLGTWKLVSSENFDDYMKALEHRNPAERITESSAEMGWQRDNHKEKASEWENGSGM

SEQ ID NO: 61976 - protein, 160 aa, Homo sapiens
  Payload ID: 12392
  Gene Symbol: PMP22
  Gene Name: peripheral myelin protein 22
  Uniprot ID: Q01453
  ENSP ID: ENSP00000308937
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAGLCVMSAAAIYTVRHPEWHLNSDYSYGFAYILAWVAFPLALLSGVIYVILRKRE

SEQ ID NO: 61977 - protein, 118 aa, Homo sapiens
  Payload ID: 12392
  Gene Symbol: PMP22
  Gene Name: peripheral myelin protein 22
  ENSP ID: ENSP00000379268
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAESNSSQMCGYRD

SEQ ID NO: 61978 - protein, 160 aa, Homo sapiens; identical to SEQ ID NO: 61976
  Payload ID: 12392
  Gene Symbol: PMP22
  Gene Name: peripheral myelin protein 22
  Uniprot ID: Q01453
  ENSP ID: ENSP00000379269

SEQ ID NO: 61979 - protein, 125 aa, Homo sapiens
  Payload ID: 12392
  Gene Symbol: PMP22
  Gene Name: peripheral myelin protein 22
  ENSP ID: ENSP00000409824
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAGKLWMVKSMWKRGASKSAE

SEQ ID NO: 61980 - protein, 161 aa, Homo sapiens [sequence omitted]

SEQ ID NO: 61981 - protein, 51 aa, Homo sapiens
  Payload ID: 12392
  Gene Symbol: PMP22
  Gene Name: peripheral myelin protein 22
  ENSP ID: ENSP00000464468
MAAVCPGHHDPVDHLQHSVSVPVLLPTLHPHQGGQVLHHWNLPNSCWSVRD

SEQ ID NO: 61982 - protein, 160 aa, Homo sapiens; identical to SEQ ID NO: 61976
  Payload ID: 12392
  Gene Symbol: PMP22
  Gene Name: peripheral myelin protein 22
  Uniprot ID: Q01453
  ENSP ID: ENSP00000484631

SEQ ID NO: 61983 - protein, 470 aa, Homo sapiens
  Payload ID: 12393
  Gene Symbol: PRPH
  Gene Name: peripherin
  Uniprot ID: P41219
  ENSP ID: ENSP00000257860
MSHHPSGLRAGFSSTSYRRTFGPPPSLSPGAFSYSSSSRFSSSRLLGSASPSSSVRLGSFRSPRAGAGALLRLPSERLDFSMAEALNQEFLATRSNEKQELQELNDRFANFIEKVRFLEQQNAALRGELSQARGQEPARADQLCQQELRELRRELELLGRERDRVQVERDGLAEDLAALKQRLEEETRKREDAEHNLVLFRKDVDDATLSRLELERKIESLMDEIEFLKKLHEEELRDLQVSVESQQVQQVEVEATVKPELTAALRDIRAQYESIAAKNLQEAEEWYKSKYADLSDAANRNHEALRQAKQEMNESRRQIQSLTCEVDGLRGTNEALLRQLRELEEQFALEAGGYQAGAARLEEELRQLKEEMARHLREYQELLNVKMALDIEIATYRKLLEGEESRISVPVHSFASLNIKTTVPEVEPPQDSHSRKTVLIKTIETRNGEVVTESQKEQRSELDKSSAHSY

SEQ ID NO: 61984 - protein, 207 aa, Homo sapiens
  Payload ID: 12393
  Gene Symbol: PRPH
  Gene Name: peripherin
  ENSP ID: ENSP00000408897
MAEALNQEFLATRSNEKQELQELNDRFANFIEKELRELRRELELLGRERDRVQVERDGLAEDLAALKQRLEEETRKREDAEHNLVLFRKDVDDATLSRLELERKIESLMDEIEFLKKLHEEELRDLQVSVESQQVQQVEVEATVKPELTAALRDIRAQYESIAAKNLQEAEEWYKSKYADLSDAANRNHEALRQAKQEMNESRRQIQ

SEQ ID NO: 61985 - protein, 200 aa, Homo sapiens
  Payload ID: 12393
  Gene Symbol: PRPH
  Gene Name: peripherin
  ENSP ID: ENSP00000437182
  MOD_RES (1)..(1): Any amino acid
XESIAAKNLQEAEEWYKSKYADLSDAANRNHEALRQAKQEMNESRRQIQSLTCEVDGLRGTNEALLRQLRELEEQFALEAGGYQAGAARLEEELRQLKEEMARHLREYQELLNVKMALDIEIATYRKLLEGEESRISVPVHSFASLNIKTTVPEVEPPQDSHSRKTVLIKTIETRNGEQVVTESQKEQRSELDKSSAHSY

SEQ ID NO: 61986 - protein, 346 aa, Homo sapiens
  Payload ID: 12394
  Gene Symbol: PRPH2
  Gene Name: peripherin 2 (retinal degeneration, slow)
  Uniprot ID: P23942
  ENSP ID: ENSP00000230381
MALLKVKFDQKKRVKLAQGLWLMNWFSVLAGIIIFSLGLFLKIELRKRSDVMNNSESHFVPNSLIGMGVLSCVFNSLAGKICYDALDPAKYARWKPWLKPYLAICVLFNIILFLVALCCFLLRGSLENTLGQGLKNGMKYYRDTDTPGRCFMKKTIDMLQIEFKCCGNNGFRDWFEIQWISNRYLDFSSKEVKDRIKSNVDGRYLVDGVPFSCCNPSSPRPCIQYQITNNSAHYSYDHQTEELNLWVRGCRAALLSYYSSLMNSMGVVTLLIWLFEVTITIGLRYLQTSLDGVSNPEESESESQGWLLERSVPETWKAFLESVKKLGKGNQVEAEGADAGQAPEAG

SEQ ID NO: 61987 - protein, 363 aa, Homo sapiens
  Payload ID: 12395
  Gene Symbol: PPHLN1
  Gene Name: periphilin 1
  ENSP ID: ENSP00000256678
MRDGFRRKSFYSSHYARERSPYKRDNTFFRESPVGRKDSPHSRSGSSVSSRSYSPERSKSYSFHQSQHRNKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIESAGQTWQQVPPVRNTEMDHDGTPENEGEETAQSHDASNHTIVGLGPNQVPEMKETTLQAPQPPQAPQPLQPRKKRVRRTTQLRRTTGAPDITWGMLKKTTQEAERILLRTQTPFTPENLFLAMLSVVHCNSRKDVKPENKQ

SEQ ID NO: 61988 - protein, 303 aa, Homo sapiens
  Payload ID: 12395
  Gene Symbol: PPHLN1
  Gene Name: periphilin 1
  ENSP ID: ENSP00000322048
MAYRRDEMWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRNKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIAGADTIQCLPGQRGFEGTSWPHNKMHSVS

SEQ ID NO: 61989 - protein, 340 aa, Homo sapiens
  Payload ID: 12395
  Gene Symbol: PPHLN1
  Gene Name: periphilin 1
  ENSP ID: ENSP00000338510
MWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIESAGQTWQQVPPVRNTEMDHDGTPENEGEETAQSNLETALIKSTLEPALCAFFL

SEQ ID NO: 61990 - protein, 367 aa, Homo sapiens
  Payload ID: 12395
  Gene Symbol: PPHLN1
  Gene Name: periphilin 1
  Uniprot ID: Q8NEY8
  ENSP ID: ENSP00000351066
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 61991 - protein, 458 aa, Homo sapiens
  Payload ID: 12395
  Gene Symbol: PPHLN1
  Gene Name: periphilin 1
  Uniprot ID: Q8NEY8
  ENSP ID: ENSP00000378935
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIESAGQTWQQVPPVRNTEMDHDGTPENEGEETAQSAPQPPQAPQPLQPRKKRVRRTTQLRRTTGAPDITWGMLKKTTQEAERILLRTQTPFTPENLFLAMLSVVHCNSRKDVKPENKQ

SEQ ID NO: 61992 - protein, 374 aa, Homo sapiens
  Payload ID: 12395
  Gene Symbol: PPHLN1
  Gene Name: periphilin 1
  Uniprot ID: Q8NEY8
  ENSP ID: ENSP00000378947
MAYRRDEMWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 61993 - protein, 348 aa, Homo sapiens
  Payload ID: 12395
  Gene Symbol: PPHLN1
  Gene Name: periphilin 1
  Uniprot ID: Q8NEY8
  ENSP ID: ENSP00000390681
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRNKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 61994 - protein, 434 aa, Homo sapiens
  Payload ID: 12395
  Gene Symbol: PPHLN1
  Gene Name: periphilin 1
  Uniprot ID: Q8NEY8
  ENSP ID: ENSP00000393965
MWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIESAGQTWQQVPPVRNTEMDHDGTPENEGEETAQSALFGFQHDASNHTIVGLGPNQVPEMKETTLQAPQPPQAPQPLQPRKKRVRRTTQLRRTTGAPDITWGMLKKTTQEAERILLRTQTPFTPENLFLAMLSVVHCNSRKDVKPENKQ

SEQ ID NO: 61995 - protein, 385 aa, Homo sapiens
  Payload ID: 12395
  Gene Symbol: PPHLN1
  Gene Name: periphilin 1
  ENSP ID: ENSP00000447168
MLRHPVRSLVQVAYRRDEMWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 61996 - protein, 107 aa, Homo sapiens
  Payload ID: 12395
  Gene Symbol: PPHLN1
  Gene Name: periphilin 1
  ENSP ID: ENSP00000448645
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYSRDGVSPC

SEQ ID NO: 61997 - protein, 37 aa, Homo sapiens
  Payload ID: 12395
  Gene Symbol: PPHLN1
  Gene Name: periphilin 1
  ENSP ID: ENSP00000449031
MTQKHQYFIQESDGYNRLVNIVPKKPPLLDRPGEGSY

SEQ ID NO: 61998 - protein, 319 aa, Homo sapiens
  Payload ID: 12395
  Gene Symbol: PPHLN1
  Gene Name: periphilin 1
  Uniprot ID: Q8NEY8
  ENSP ID: ENSP00000449331
MAYRRDEMWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 61999 - protein, 168 aa, Homo sapiens
  Payload ID: 12395
  Gene Symbol: PPHLN1
  Gene Name: periphilin 1
  ENSP ID: ENSP00000449772
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQ

SEQ ID NO: 62000 - protein, 161 aa, Homo sapiens
  Payload ID: 12395
  Gene Symbol: PPHLN1
  Gene Name: periphilin 1
  ENSP ID: ENSP00000450274
MAYRRDEMWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSY

SEQ ID NO: 62001 - protein, 52 aa, Homo sapiens
  Payload ID: 12395
  Gene Symbol: PPHLN1
  Gene Name: periphilin 1
  ENSP ID: ENSP00000450346
MAYRRDEMWSEGRYEYERIPRERAPPRSHPSDESGYRWTRDDHSASRQPEYR

SEQ ID NO: 62002 - protein, 434 aa, Homo sapiens; identical to SEQ ID NO: 61994
  Payload ID: 12395
  Gene Symbol: PPHLN1
  Gene Name: periphilin 1
  Uniprot ID: Q8NEY8
  ENSP ID: ENSP00000477681

SEQ ID NO: 62003 - protein, 348 aa, Homo sapiens; identical to SEQ ID NO: 61993
  Payload ID: 12395
  Gene Symbol: PPHLN1
  Gene Name: periphilin 1
  Uniprot ID: Q8NEY8
  ENSP ID: ENSP00000478872

SEQ ID NO: 62004 - protein, 458 aa, Homo sapiens; identical to SEQ ID NO: 61991
  Payload ID: 12395
  Gene Symbol: PPHLN1
  Gene Name: periphilin 1
  Uniprot ID: Q8NEY8
  ENSP ID: ENSP00000479913

SEQ ID NO: 62005 - protein, 1756 aa, Homo sapiens
  Payload ID: 12396
  Gene Symbol: PPL
  Gene Name: periplakin
  Uniprot ID: O60437
  ENSP ID: ENSP00000340510
MNSLFRKRNKGKYSPTVQTRSISNKELSELIEQLQKNADQVEKNIVDTEAKMQSDLARLQEGRQPEHRDVTLQKVLDSEKLLYVLEADAAIAKHMKHPQGDMIAEDIRQLKERVTNLRGKHKQIYRLAVKEVDPQVNWAALVEEKLDKLNNQSFGTDLPLVDHQVEEHNIFHNEVKAIGPHLAKDGDKEQNSELRAKYQKLLAASQARQQHLSSLQDYMQRCTNELYWLDQQAKGRMQYDWSDRNLDYPSRRRQYENFINRNLEAKEERINKLHSEGDQLLAAEHPGRNSIEAHMEAVHADWKEYLNLLICEESHLKYMEDYHQFHEDVKDAQELLRKVDSDLNQKYGPDFKDRYQIELLLRELDDQEKVLDKYEDVVQGLQKRGQQVVPLKYRRETPLKPIPVEALCDFEGEQGLISRGYSYTLQKNNGESWELMDSAGNKLIAPAVCFVIPPTDPEALALADSLGSQYRSVRQKAAGSKRTLQQRYEVLKTENPGDASDLQGRQLLAGLDKVASDLDRQEKAITGILRPPLEQGRAVQDSAERAKDLKNITNELLRIEPEKTRSTAEGEAFIQALPGSGTTPLLRTRVEDTNRKYEHLLQLLDLAQEKVDVANRLEKSLQQSWELLATHENHLNQDDTVPESSRVLDSKGQELAAMACELQAQKSLLGEVEQNLQAAKQCSSTLASRFQEHCPDLERQEAEVHKLGQRFNNLRQQVERRAQSLQSAKAAYEHFHRGHDHVLQFLVSIPSYEPQETDSLSQMETKLKNQKNLLDEIASREQEVQKICANSQQYQQAVKDYELEAEKLRSLLDLENGRRSHVSKRARLQSPATKVKEEEAALAAKFTEVYAINRQRLQNLEFALNLLRQQPEVEVTHETLQRNRPDSGVEEAWKIRKELDEETERRRQLENEVKSTQEEIWTLRNQGPQESVVRKEVLKKVPDPVLEESFQQLQRTLAEEQHKNQLLQEELEALQLQLRALEQETRDGGQEYVVKEVLRIEPDRAQADEVLQLREELEALRRQKGAREAEVLLLQQRVAALAEEKSRAQEKVTEKEVVKLQNDPQLEAEYQQLQEDHQRQDQLREKQEEELSFLQDKLKRLEKERAMAEGKITVKEVLKVEKDAATEREVSDLTRQYEDEAAKARASQREKTELLRKIWALEEENAKVVVQEKVREIVRPDPKAESEVANLRLELVEQERKYRGAEEQLRSYQSELEALRRRGPQVEVKEVTKEVIKYKTDPEMEKELQRLREEIVDKTRLIERCDLEIYQLKKEIQALKDTKPQVQTKEVVQEILQFQEDPQTKEEVASLRAKLSEEQKKQVDLERERASQEEQIARKEEELSRVKERVVQQEVVRYEEEPGLRAEASAFAESIDVELRQIDKLRAELRRLQRRRTELERQLEELERERQARREAEREVQRLQQRLAALEQEEAEAREKVTHTQKVVLQQDPQQAREHALLRLQLEEEQHRRQLLEGELETLRRKLAALEKAEVKEKVVLSESVQVEKGDTEQEIQRLKSSLEEESRSKRELDVEVSRLEARLSELEFHNSKSSKELDFLREENHKLQLERQNLQLETRRLQSEINMAATETRDLRNMTVADSGTNHDSRLWSLERELDDLKRLSKDKDLEIDELQKRLGSVAVKREQRENHLRRSIVVIHPDTGRELSPEEAHRAGLIDWNMFVKLRSQECDWEEISVKGPNGESSVIHDRKSGKKFSIEEALQSGRLTPAQYDRYVNKDMSIQELAVLVSGQK

SEQ ID NO: 62006 - protein, 1754 aa, Homo sapiens
  Payload ID: 12396
  Gene Symbol: PPL
  Gene Name: periplakin
  ENSP ID: ENSP00000465640
MNSLFRKRNKGKYSPTVQTRSISNKELSELIEQLQKNADQVEKNIVDTEAKMQSDLARLQEGRQPEHRDVTLQKVLDSEKLLYVLEADAAIAKHMKHPQGDMIAEDIRQLKERVTNLRGKHKQIYRLAVKEVDPQVNWAALVEEKLDKLNNQSFGTDLPLVDHQVEEHNIFHNEVKAIGPHLAKDGDKNSELRAKYQKLLAASQARQQHLSSLQDYMQRCTNELYWLDQQAKGRMQYDWSDRNLDYPSRRRQYENFINRNLEAKEERINKLHSEGDQLLAAEHPGRNSIEAHMEAVHADWKEYLNLLICEESHLKYMEDYHQFHEDVKDAQELLRKVDSDLNQKYGPDFKDRYQIELLLRELDDQEKVLDKYEDVVQGLQKRGQQVVPLKYRRETPLKPIPVEALCDFEGEQGLISRGYSYTLQKNNGESWELMDSAGNKLIAPAVCFVIPPTDPEALALADSLGSQYRSVRQKAAGSKRTLQQRYEVLKTENPGDASDLQGRQLLAGLDKVASDLDRQEKAITGILRPPLEQGRAVQDSAERAKDLKNITNELLRIEPEKTRSTAEGEAFIQALPGSGTTPLLRTRVEDTNRKYEHLLQLLDLAQEKVDVANRLEKSLQQSWELLATHENHLNQDDTVPESSRVLDSKGQELAAMACELQAQKSLLGEVEQNLQAAKQCSSTLASRFQEHCPDLERQEAEVHKLGQRFNNLRQQVERRAQSLQSAKAAYEHFHRGHDHVLQFLVSIPSYEPQETDSLSQMETKLKNQKNLLDEIASREQEVQKICANSQQYQQAVKDYELEAEKLRSLLDLENGRRSHVSKRARLQSPATKVKEEEAALAAKFTEVYAINRQRLQNLEFALNLLRQQPEVEVTHETLQRNRPDSGVEEAWKIRKELDEETERRRQLENEVKSTQEEIWTLRNQGPQESVVRKEVLKKVPDPVLEESFQQLQRTLAEEQHKNQLLQEELEALQLQLRALEQETRDGGQEYVVKEVLRIEPDRAQADEVLQLREELEALRRQKGAREAEVLLLQQRVAALAEEKSRAQEKVTEKEVVKLQNDPQLEAEYQQLQEDHQRQDQLREKQEEELSFLQDKLKRLEKERAMAEGKITVKEVLKVEKDAATEREVSDLTRQYEDEAAKARASQREKTELLRKIWALEEENAKVVVQEKVREIVRPDPKAESEVANLRLELVEQERKYRGAEEQLRSYQSELEALRRRGPQVEVKEVTKEVIKYKTDPEMEKELQRLREEIVDKTRLIERCDLEIYQLKKEIQALKDTKPQVQTKEVVQEILQFQEDPQTKEEVASLRAKLSEEQKKQVDLERERASQEEQIARKEEELSRVKERVVQQEVVRYEEEPGLRAEASAFAESIDVELRQIDKLRAELRRLQRRRTELERQLEELERERQARREAEREVQRLQQRLAALEQEEAEAREKVTHTQKVVLQQDPQQAREHALLRLQLEEEQHRRQLLEGELETLRRKLAALEKAEVKEKVVLSESVQVEKGDTEQEIQRLKSSLEEESRSKRELDVEVSRLEARLSELEFHNSKSSKELDFLREENHKLQLERQNLQLETRRLQSEINMAATETRDLRNMTVADSGTNHDSRLWSLERELDDLKRLSKDKDLEIDELQKRLGSVAVKREQRENHLRRSIVVIHPDTGRELSPEEAHRAGLIDWNMFVKLRSQECDWEEISVKGPNGESSVIHDRKSGKKFSIEEALQSGRLTPAQYDRYVNKDMSIQELAVLVSGQK

SEQ ID NO: 62007 - protein, 1115 aa, Homo sapiens
  Payload ID: 12396
  Gene Symbol: PPL
  Gene Name: periplakin
  ENSP ID: ENSP00000467699
MQSDLARLQEGRQPEHRDVTLQKVLDSEKLLYVLEADAAIAKHMKHPQGDMIAEDIRQLKERVTNLRGKHKQIYRLAVKEVDPQAQKSLLGEVEQNLQAAKQCSSTLASRFQEHCPDLERQEAEVHKLGQRFNNLRQQVERRAQSLQSAKAAYEHFHRGHDHVLQFLVSIPSYEPQETDSLSQMETKLKNQKNLLDEIASREQEVQKICANSQQYQQAVKDYELEAEKLRSLLDLENGRRSHVSKRARLQSPATKVKEEEAALAAKFTEVYAINRQRLQNLEFALNLLRQQPEVEVTHETLQRNRPDSGVEEAWKIRKELDEETERRRQLENEVKSTQEEIWTLRNQGPQESVVRKEVLKKVPDPVLEESFQQLQRTLAEEQHKNQLLQEELEALQLQLRALEQETRDGGQEYVVKEVLRIEPDRAQADEVLQLREELEALRRQKGAREAEVLLLQQRVAALAEEKSRAQEKVTEKEVVKLQNDPQLEAEYQQLQEDHQRQDQLREKQEEELSFLQDKLKRLEKERAMAEGKITVKEVLKVEKDAATEREVSDLTRQYEDEAAKARASQREKTELLRKIWALEEENAKVVVQEKVREIVRPDPKAESEVANLRLELVEQERKYRGAEEQLRSYQSELEALRRRGPQVEVKEVTKEVIKYKTDPEMEKELQRLREEIVDKTRLIERCDLEIYQLKKEIQALKDTKPQVQTKEVVQEILQFQEDPQTKEEVASLRAKLSEEQKKQVDLERERASQEEQIARKEEELSRVKERVVQQEVVRYEEEPGLRAEASAFAESIDVELRQIDKLRAELRRLQRRRTELERQLEELERERQARREAEREVQRLQQRLAALEQEEAEAREKVTHTQKVVLQQDPQQAREHALLRLQLEEEQHRRQLLEGELETLRRKLAALEKAEVKEKVVLSESVQVEKGDTEQEIQRLKSSLEEESRSKRELDVEVSRLEARLSELEFHNSKSSKELDFLREENHKLQLERQNLQLETRRLQSEINMAATETRDLRNMTVADSGTNHDSRLWSLERELDDLKRLSKDKDLEIDELQKRLGSVAVKREQRENHLRRSIVVIHPDTGRELSPEEAHRAGLIDWNMFVKLRSQECD

SEQ ID NO: 62008 - protein, 1479 aa, Homo sapiens
  Payload ID: 12397
  Gene Symbol: PXDN
  Gene Name: peroxidasin
  Uniprot ID: Q92626
  ENSP ID: ENSP00000252804
MAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVCSNDPPCFSVMIPPNDSRARSGARCMFFVRSSPVCGSGMTSLLMNSVYPREQINQLTSYIDASNVYGSTEHEARSIRDLASHRGLLRQGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 62009 - protein, 224 aa, Homo sapiens
  Payload ID: 12397
  Gene Symbol: PXDN
  Gene Name: peroxidasin
  ENSP ID: ENSP00000398363
MAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRI

SEQ ID NO: 62010 - protein, 723 aa, Homo sapiens
  Payload ID: 12397
  Gene Symbol: PXDN
  Gene Name: peroxidasin
  ENSP ID: ENSP00000402738
  MOD_RES (1)..(1): Any amino acid
XRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSQCQSLFFLLHGLSNGVEHASVKSHS

SEQ ID NO: 62011 - protein, 196 aa, Homo sapiens
  Payload ID: 12397
  Gene Symbol: PXDN
  Gene Name: peroxidasin
  ENSP ID: ENSP00000408701
  MOD_RES (1)..(1): Any amino acid
XGSWFPSAPGLSTTVLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGN

SEQ ID NO: 62012 - protein, 76 aa, Homo sapiens
  Payload ID: 12397
  Gene Symbol: PXDN
  Gene Name: peroxidasin
  ENSP ID: ENSP00000414098
  MOD_RES (1)..(1): Any amino acid
XVQSDVFRVAEFPHGYGSCDEIPRVDLRVWQDCCEDCRTRGQFNAFSYHFRGRRSLEFSYQEDKPTKKTRPRKIPR

SEQ ID NO: 62013 - protein, 1463 aa, Homo sapiens
  Payload ID: 12398
  Gene Symbol: PXDNL
  Gene Name: peroxidasin-like
  Uniprot ID: A1KZ92
  ENSP ID: ENSP00000348645
MEPRLFCWTTLFLLAGWCLPGLPCPSRCLCFKSTVRCMHLMLDHIPQVPQQTTVLDLRFNRIREIPGSAFKKLKNLNTLLLNNNHIRKISRNAFEGLENLLYLYLYKNEIHALDKQTFKGLISLEHLYIHFNQLEMLQPETFGDLLRLERLFLHNNKLSKIPAGSFSNLDSLKRLRLDSNALVCDCDLMWLGELLQGFAQHGHTQAAATCEYPRRLHGRAVASVTVEEFNCQSPRITFEPQDVEVPSGNTVYFTCRAEGNPKPEIIWIHNNHSLDLEDDTRLNVFDDGTLMIRNTRESDQGVYQCMARNSAGEAKTQSAMLRYSSLPAKPSFVIQPQDTEVLIGTSTTLECMATGHPHPLITWTRDNGLELDGSRHVATSSGLYLQNITQRDHGRFTCHANNSHGTVQAAANIIVQAPPQFTVTPKDQVVLEEHAVEWLCEADGNPPPVIVWTKTGGQLPVEGQHTVLSSGTLRIDRAAQHDQGQYECQAVSSLGVKKVSVQLTVKPKALAVFTQLPQDTSVEVGKNINISCHAQGEPQPIITWNKEGVQITESGKFHVDDEGTLTIYDAGFPDQGRYECVARNSFGLAVTNMFLTVTAIQGRQAGDDFVESSILDAVQRVDSAINSTRRHLFSQKPHTSSDLLAQFHYPRDPLIVEMARAGEIFEHTLQLIRERVKQGLTVDLEGKEFRYNDLVSPRSLSLIANLSGCTARRPLPNCSNRCFHAKYRAHDGTCNNLQQPTWGAALTAFARLLQPAYRDGIRAPRGLGLPVGSRQPLPPPRLVATVWARAAAVTPDHSYTRMLMHWGWFLEHDLDHTVPALSTARFSDGRPCSSVCTNDPPCFPMNTRHADPRGTHAPCMLFARSSPACASGRPSATVDSVYAREQINQQTAYIDGSNVYGSSERESQALRDPSVPRGLLKTGFPWPPSGKPLLPFSTGPPTECARQEQESPCFLAGDHRANEHLALAAMHTLWFREHNRMATELSALNPHWEGNTVYQEARKIVGAELQHITYSHWLPKVLGDPGTRMLRGYRGYNPNVNAGIINSFATAAFRFGHTLINPILYRLNATLGEISEGHLPFHKALFSPSRIIKEGGIDPVLRGLFGVAAKWRAPSYLLSPELTQRLFSAAYSAAVDSAATIIQRGRDHGIPPYVDFRVFCNLTSVKNFEDLQNEIKDSEIRQKLRKLYGSPGDIDLWPALMVEDLIPGTRVGPTLMCLFVTQFQRLRDGDRFWYENPGVFTPAQLTQLKQASLSRVLCDNGDSIQQVQADVFVKAEYPQDYLNCSEIPKVDLRVWQDCCADCRSRGQFRAVTQESQKKRSAQYSYPVDKDMELSHLRSRQQDKIYVGEDARNVTVLAKTKFSQDFSTFAAEIQETITALREQINKLEARLRQAGCTDVRGVPRKAEERWMKEDCTHCICESGQVTCVVEICPPAPCPSPELVKGTCCPVCRDRGMPSDSPEKR

SEQ ID NO: 62014 - protein, 537 aa, Homo sapiens
  Payload ID: 12398
  Gene Symbol: PXDNL
  Gene Name: peroxidasin-like
  ENSP ID: ENSP00000428114
  MOD_RES (1)..(1): Any amino acid
XAREQINQQTAYIDGSNVYGSSERESQALRDPSVPRGLLKTGFPWPPSGKPLLPFSTGPPTECARQEQESPCFLAGDHRANEHLALAAMHTLWFREHNRMATELSALNPHWEGNTVYQEARKIVGAELQHITYSHWLPKVLGDPGTRMLRGYRGYNPNVNAGIINSFATAAFRFGHTLINPILYRLNATLGEISEGHLPFHKALFSPSRIIKEGGIDPVLRGLFGVAAKWRAPSYLLSPELTQRLFSAAYSAAVDSAATIIQRGRDHGIPPYVDFRVFCNLTSVKNFEDLQNEIKDSEIRQKLRKFWYENPGVFTPAQLTQLKQASLSRVLCDNGDSIQQVQADVFVKAEYPQDYLNCSEIPKVDLRVWQDCCADCRSRGQFRAVTQESQKKRSAQYSYPVDKDMELSHLRSRQQDKIYVGEDARNVTVLAKTKFSQDFSTFAAEIQETITALREQINKLEARLRQAGCTDVRGVPRKAEERWMKEDCTHCICESGQVTCVVEICPPAPCPSPELVKGTCCPVCRDRGMPSDSPEKR

SEQ ID NO: 62015 - protein, 582 aa, Homo sapiens
  Payload ID: 12398
  Gene Symbol: PXDNL
  Gene Name: peroxidasin-like
  ENSP ID: ENSP00000429855
NNLQQPTWGAALTAFARLLQPAYRDGIRAPRGLGLPVGSRQPLPPPRLVATVWARAAAVTPDHSYTRMLMHWGWFLEHDLDHTVPALSTARFSDGRPCSSVCTNDPPCFPMNTRHADPRGTHAPCMLFARSSPACASGRPSATVDSVYAREQINQQTAYIDGSNVYGSSERESQALRDPSVPRGLLKTGFPWPPSGKPLLPFSTGPPTECARQEQESPCFLAGDHRANEHLALAAMHTLWFREHNRMATELSALNPHWEGNTVYQEARKIVGAELQHITYSHWLPKVLGDPGTRMLRGYRGYNPNVNAGIINSFATAAFRFGHTLINPILYRLNATLGEISEGHLPFHKALFSPSRIIKEGGIDPVLRGLFGVAAKWRAPSYLLSPELTQRLFSAAYSAAVDSAATIIQRGRDHGIPPYVDFRVFCNLTSVKNFEDLQNEIKDSEIRQKLRKLYGSPGDIDLWPALMVEDLIPGTRVGPTLMCLFVTQFQRLRDGDRFWYENPGVFTPAQLTQLKQASLSRVLCDNGDSIQQVQADVFVKAEYPQDYLNCSEIPKVDLRVWQDCCADKQAGGTPEAGRVYRC

SEQ ID NO: 62016 - protein, 199 aa, Homo sapiens
  Payload ID: 12399
  Gene Symbol: PRDX1
  Gene Name: peroxiredoxin 1
  Uniprot ID: Q06830
  ENSP ID: ENSP00000262746
MSSGNAKIGHPAPNFKATAVMPDGQFKDISLSDYKGKYVVFFFYPLDFTFVCPTEIIAFSDRAEEFKKLNCQVIGASVDSHFCHLAWVNTPKKQGGLGPMNIPLVSDPKRTIAQDYGVLKADEGISFRGLFIIDDKGILRQITVNDLPVGRSVDETLRLVQAFQFTDKHGEVCPAGWKPGSDTIKPDVQKSKEYFSKQK

SEQ ID NO: 62017 - protein, 97 aa, Homo sapiens
  Payload ID: 12399
  Gene Symbol: PRDX1
  Gene Name: peroxiredoxin 1
  ENSP ID: ENSP00000361150
MSSGNAKIGHPAPNFKATADEGISFRGLFIIDDKGILRQITVNDLPVGRSVDETLRLVQAFQFTDKHGEVCPAGWKPGSDTIKPDVQKSKEYFSKQK

SEQ ID NO: 62018 - protein, 199 aa, Homo sapiens; identical to SEQ ID NO: 62016
  Payload ID: 12399
  Gene Symbol: PRDX1
  Gene Name: peroxiredoxin 1
  Uniprot ID: Q06830
  ENSP ID: ENSP00000361152

SEQ ID NO: 62019 - protein, 171 aa, Homo sapiens
  Payload ID: 12399
  Gene Symbol: PRDX1
  Gene Name: peroxiredoxin 1
  ENSP ID: ENSP00000389047
MSSGNAKIGHPAPNFKATAVMPDGQFKDISLSDYKGKYVVFFFYPLDFTFVCPTEIIAFSDRAEEFKKLNCQVIGASVDSHFCHLAWVNTPKKQGGLGPMNIPLVSDPKRTIAQDYGVLKADEGISFRGLFIIDDKGILRQITVNDLPVGRSVDETLRLVQAFQFTDKHGE

SEQ ID NO: 62020 - protein, 171 aa, Homo sapiens; identical to SEQ ID NO: 62019
  Payload ID: 12399
  Gene Symbol: PRDX1
  Gene Name: peroxiredoxin 1
  ENSP ID: ENSP00000407034

SEQ ID NO: 62021 - protein, 198 aa, Homo sapiens
  Payload ID: 12400
  Gene Symbol: PRDX2
  Gene Name: peroxiredoxin 2
  Uniprot ID: P32119
  ENSP ID: ENSP00000301522
MASGNARIGKPAPDFKATAVVDGAFKEVKLSDYKGKYVVLFFYPLDFTFVCPTEIIAFSNRAEDFRKLGCEVLGVSVDSQFTHLAWINTPRKEGGLGPLNIPLLADVTRRLSEDYGVLKTDEGIAYRGLFIIDGKGVLRQITVNDLPVGRSVDEALRLVQAFQYTDEHGEVCPAGWKPGSDTIKPNVDDSKEYFSKHN

SEQ ID NO: 62022 - protein, 136 aa, Homo sapiens
  Payload ID: 12400
  Gene Symbol: PRDX2
  Gene Name: peroxiredoxin 2
  ENSP ID: ENSP00000334063
MASGNARIGKPAPDFKATAVVDGAFKEVKLSDYKGKYVVLFFYPLDFTFVCPTEIIAFSNRAEDFRKLGCEVLGVSVDSQFTHLAWINTPRKEGGLGPLNIPLLADVTRRLSEDYGVLKTDEGIAYSLSRWLEAWQ

SEQ ID NO: 62023 - protein, 256 aa, Homo sapiens
  Payload ID: 12401
  Gene Symbol: PRDX3
  Gene Name: peroxiredoxin 3
  Uniprot ID: P30048
  ENSP ID: ENSP00000298510
MAAAVGRLLRASVARHVSAIPWGISATAALRPAACGRTSLTNLLCSGSSQAKLFSTSSSCHAPAVTQHAPYFKGTAVVNGEFKDLSLDDFKGKYLVLFFYPLDFTFVCPTEIVAFSDKANEFHDVNCEVVAVSVDSHFSHLAWINTPRKNGGLGHMNIALLSDLTKQISRDYGVLLEGSGLALRGLFIIDPNGVIKHLSVNDLPVGRSVEETLRLVKAFQYVETHGEVCPANWTPDSPTIKPSPAASKEYFQKVNQ

SEQ ID NO: 62024 - protein, 186 aa, Homo sapiens
  Payload ID: 12402
  Gene Symbol: PRDX4
  Gene Name: peroxiredoxin 4
  ENSP ID: ENSP00000368635
MEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWSVSYTYIRRKKRMDLLLKHGQITLDMI

SEQ ID NO: 62025 - protein, 271 aa, Homo sapiens
  Payload ID: 12402
  Gene Symbol: PRDX4
  Gene Name: peroxiredoxin 4
  Uniprot ID: Q13162
  ENSP ID: ENSP00000368646
MEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 62026 - protein, 185 aa, Homo sapiens
  Payload ID: 12402
  Gene Symbol: PRDX4
  Gene Name: peroxiredoxin 4
  ENSP ID: ENSP00000368654
MDHRSRLRGTGLNRIPGTQSRAPRVPLPFHVQQEAREGEDWEREPPRQRPPIYEPPESEELPDNVMVSKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTL

SEQ ID NO: 62027 - protein, 161 aa, Homo sapiens
  Payload ID: 12402
  Gene Symbol: PRDX4
  Gene Name: peroxiredoxin 4
  ENSP ID: ENSP00000413736
  MOD_RES (1)..(1): Any amino acid
XCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIKPEDTMKAWWPRESYNPRSSWKAEVFR

SEQ ID NO: 62028 - protein, 214 aa, Homo sapiens
  Payload ID: 12403
  Gene Symbol: PRDX5
  Gene Name: peroxiredoxin 5
  Uniprot ID: P30044
  ENSP ID: ENSP00000265462
MGLAGVCALRRSAGYILVGGAGGQSAAAAARRYSEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 62029 - protein, 170 aa, Homo sapiens
  Payload ID: 12403
  Gene Symbol: PRDX5
  Gene Name: peroxiredoxin 5
  Uniprot ID: P30044
  ENSP ID: ENSP00000335334
MGLAGVCALRRSAGYILVGGAGGQSAAAAARRYSEGEWASGGVRSFSRAAAAMAPIKVGDAIPAVEVFEGEPGNKVNLAELFKGKKGVLFGVPGAFTPGCSKVRLLADPTGAFGKETDLLLDDSLVSIFGNRRLKRFSMVVQDGIVKALNVEPDGTGLTCSLAPNIISQL

SEQ ID NO: 62030 - protein, 125 aa, Homo sapiens
  Payload ID: 12403
  Gene Symbol: PRDX5
  Gene Name: peroxiredoxin 5
  Uniprot ID: P30044
  ENSP ID: ENSP00000335363
MGLAGVCALRRSAGYILVGGAGGQSAAAAARRYSEGEWASGGVRSFSRAAAAMAPIKVRLLADPTGAFGKETDLLLDDSLVSIFGNRRLKRFSMVVQDGIVKALNVEPDGTGLTCSLAPNIISQL

SEQ ID NO: 62031 - protein, 224 aa, Homo sapiens
  Payload ID: 12404
  Gene Symbol: PRDX6
  Gene Name: peroxiredoxin 6
  Uniprot ID: P30041
  ENSP ID: ENSP00000342026
MPGGLLLGDVAPNFEANTTVGRIRFHDFLGDSWGILFSHPRDFTPVCTTELGRAAKLAPEFAKRNVKLIALSIDSVEDHLAWSKDINAYNCEEPTEKLPFPIIDDRNRELAILLGMLDPAEKDEKGMPVTARVVFVFGPDKKLKLSILYPATTGRNFDEILRVVISLQLTAEKRVATPVDWKDGDSVMVLPTIPEEEAKKLFPKGVFTKELPSGKKYLRYTPQP

SEQ ID NO: 62032 - protein, 1283 aa, Homo sapiens
  Payload ID: 12405
  Gene Symbol: PEX1
  Gene Name: peroxisomal biogenesis factor 1
  Uniprot ID: O43933
  ENSP ID: ENSP00000248633
MWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGVYVLAATSRPDLIDPALLRPGRLDKCVYCPPPDQVSRLEILNVLSDSLPLADDVDLQHVASVTDSFTGADLKALLYNAQLEALHGMLLSSGLQDGSSSSDSDLSLSSMVFLNHSSGSDDSAGDGECGLDQSLVSLEMSEILPDESKFNMYRLYFGSSYESELGNGTSSDLSSQCLSAPSSMTQDLPGVPGKDQLFSQPPVLRTASQEGCQELTQEQRDQLRADISIIKGRYRSQSGEDESMNQPGPIKTRLAISQSHLMTALGHTRPSISEDDWKNFAELYESFQNPKRRKNQSGTMFRPGQKVTLA

SEQ ID NO: 62033 - protein, 196 aa, Homo sapiens
  Payload ID: 12405
  Gene Symbol: PEX1
  Gene Name: peroxisomal biogenesis factor 1
  ENSP ID: ENSP00000389594
  MOD_RES (1)..(1): Any amino acid
XKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQRSEFLRRILLGAHHSQPPGTPFVSAADVSCCRT

SEQ ID NO: 62034 - protein, 1226 aa, Homo sapiens
  Payload ID: 12405
  Gene Symbol: PEX1
  Gene Name: peroxisomal biogenesis factor 1
  ENSP ID: ENSP00000394413
MWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGVYVLAATSRPDLIDPALLRPGRLDKCVYCPPPDQVSRLEILNVLSDSLPLADDVDLQHVASVTDSFTGADLKALLYNAQLEALHGMLLSSGLQDGSSSSDSDLSLSSMVFLNHSSGSDDSAGDGECGLDQSLVSLEMSEILPDESKFNMYRLYFGSSYESELGNGTSSDLSSQCLSAPSSMTQDLPGVPGKDQLFSQPPVLRTASQEGCQELTQEQRDQLRADISIIKGRYRSQSGEDESMNQPGPIKTRLAISQSHLMTALGHTRPSISEDDWKNFAELYESFQNPKRRKNQSGTMFRPGQKVTLA

SEQ ID NO: 62035 - protein, 961 aa, Homo sapiens
  Payload ID: 12405
  Gene Symbol: PEX1
  Gene Name: peroxisomal biogenesis factor 1
  Uniprot ID: O43933
  ENSP ID: ENSP00000410438
MWGSDRLAGAGGGGAAVTVAFTNARDCFLHLPRRLVAQLHLLQNQAIEVVWSHQPAFLSWVEGRHFSDQGENVAEINRQVGQKLGLSNGGQIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGVYVLAATSRPDLIDPALLRPGRLDKCVYCPPPDQVSRLEILNVLSDSLPLADDVDLQHVASVTDSFTGADLKALLYNAQLEALHGMLLSSGLQDGSSSSDSDLSLSSMVFLNHSSGSDDSAGDGECGLDQSLVSLEMSEILPDESKFNMYRLYFGSSYESELGNGTSSDLSSQCLSAPSSMTQDLPGVPGKDQLFSQPPVLRTASQEGCQELTQEQRDQLRADISIIKGRYRSQSGEDESMNQPGPIKTRLAISQSHLMTALGHTRPSISEDDWKNFAELYESFQNPKRRKNQSGTMFRPGQKVTLA

SEQ ID NO: 62036 - protein, 346 aa, Homo sapiens
  Payload ID: 12406
  Gene Symbol: PEX10
  Gene Name: peroxisomal biogenesis factor 10
  Uniprot ID: O60683
  ENSP ID: ENSP00000288774
MAPAAASPPEVIRAAQKDEYYRGGLRSAAGGALHSLAGARKWLEWRKEVELLSDVAYFGLTTLAGYQTLGEEYVSIIQVDPSRIHVPSSLRRGVLVTLHAVLPYLLDKALLPLEQELQADPDSGRPLQGSLGPGGRGCSGARRWMRHHTATLTEQQRRALLRAVFVLRQGLACLQRLHVAWFYIHGVFYHLAKRLTGITYQALRPDPLRVLMSVAPSALQLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKAECPLCREKFPPQKLIYLRHYR

SEQ ID NO: 62037 - protein, 326 aa, Homo sapiens
  Payload ID: 12406
  Gene Symbol: PEX10
  Gene Name: peroxisomal biogenesis factor 10
  Uniprot ID: O60683
  ENSP ID: ENSP00000407922
MAPAAASPPEVIRAAQKDEYYRGGLRSAAGGALHSLAGARKWLEWRKEVELLSDVAYFGLTTLAGYQTLGEEYVSIIQVDPSRIHVPSSLRRGVLVTLHAVLPYLLDKALLPLEQELQADPDSGRPLQGSLGPGGRGCSGARRWMRHHTATLTEQQRRALLRAVFVLRQGLACLQRLHVAWFYIHGVFYHLAKRLTGITYLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKAECPLCREKFPPQKLIYLRHYR

SEQ ID NO: 62038 - protein, 209 aa, Homo sapiens
  Payload ID: 12406
  Gene Symbol: PEX10
  Gene Name: peroxisomal biogenesis factor 10
  ENSP ID: ENSP00000423051
MAPAAASPPEVIRAAQKDEYYRGGLRSAAGGALHSLAGARKWLEWRKEVELLSDVAYFGLTTLAGYQTLGEEYVSIIQVDPSRIHVPSSLRRGVLVTLHAVLPYLLDKALLPLEQELQADPDSGRPLQGSLGPGGRGCSGARRWMRHHTATLTEQQRRALLRAVFVLRQGLACLQRLHVAWFYIHGVFYHLAKRLTGITSVSAACPERT

SEQ ID NO: 62039 - protein, 324 aa, Homo sapiens
  Payload ID: 12406
  Gene Symbol: PEX10
  Gene Name: peroxisomal biogenesis factor 10
  ENSP ID: ENSP00000424291
MAPAAASPPEVIRAAQKDEYYRGGLRSAAGGALHSLAGARKWLEWRKEVELLSDVAYFGLTTLAGYQTLGEEYVSIIQVDPSRIHVPSSLRRGVLVTLHAVLPYLLDKALLPLEQELQADPDSGRPLQGSLGPGGRGCSGARRWMRHHTATLTEQQRRALLRAVFVLRQGLACLQRLHVAWFYIHGVFYHLAKRLTGITYLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKCPLCREKFPPQKLIYLRHYR

SEQ ID NO: 62040 - protein, 73 aa, Homo sapiens
  Payload ID: 12406
  Gene Symbol: PEX10
  Gene Name: peroxisomal biogenesis factor 10
  ENSP ID: ENSP00000425924
MAPAAASPPEVIRAAQKDEYYRGGLRSAAGGALHSLAGLITLLIDEQIEIPERPHSQQVGELLFDARQLASGL

SEQ ID NO: 62041 - protein, 25 aa, Homo sapiens
  Payload ID: 12406
  Gene Symbol: PEX10
  Gene Name: peroxisomal biogenesis factor 10
  ENSP ID: ENSP00000461951
EIPERPHSQQVGELLFDARQLASGL

SEQ ID NO: 62042 - protein, 30 aa, Homo sapiens
  Payload ID: 12406
  Gene Symbol: PEX10
  Gene Name: peroxisomal biogenesis factor 10
  ENSP ID: ENSP00000464289
MRHHTATLTEQQRRALLRAVFVLRQGLACL

SEQ ID NO: 62043 - protein, 247 aa, Homo sapiens
  Payload ID: 12407
  Gene Symbol: PEX11A
  Gene Name: peroxisomal biogenesis factor 11 alpha
  Uniprot ID: O75192
  ENSP ID: ENSP00000300056
MDAFTRFTNQTQGRDRLFRATQYTCMLLRYLLEPKAGKEKVVMKLKKLESSVSTGRKWFRLGNVVHAIQATEQSIHATDLVPRLCLTLANLNRVIYFICDTILWVRSVGLTSGINKEKWRTRAAHHYYYSLLLSLVRDLYEISLQMKRVTCDRAKKEKSASQDPLWFSVAEEETEWLQSFLLLLFRSLKQHPPLLLDTVKNLCDILNPLDQLGIYKSNPGIIGLGGLVSSIAGMITVAYPQMKLKTR

SEQ ID NO: 62044 - protein, 216 aa, Homo sapiens
  Payload ID: 12407
  Gene Symbol: PEX11A
  Gene Name: peroxisomal biogenesis factor 11 alpha
  Uniprot ID: O75192
  ENSP ID: ENSP00000453492
MDAFTRFTNQTQGRDRLFRATQYTCMLLRYLLEPKAGKEKVVMKLKKLESSVSTGRKSNLNRVIYFICDTILWVRSVGLTSGINKEKWRTRAAHHYYYSLLLSLVRDLYEISLQMKRVTCDRAKKEKSASQDPLWFSVAEEETEWLQSFLLLLFRSLKQHPPLLLDTVKNLCDILNPLDQLGIYKSNPGIIGLGGLVSSIAGMITVAYPQMKLKTR

SEQ ID NO: 62045 - protein, 64 aa, Homo sapiens
  Payload ID: 12407
  Gene Symbol: PEX11A
  Gene Name: peroxisomal biogenesis factor 11 alpha
  ENSP ID: ENSP00000453552
MDAFTRFTNQTQGRDRLFRATQYTCMLLRYLLEPKAGKEKVVMKLKKLESSVSTGRKYKIDLCL

SEQ ID NO: 62046 - protein, 32 aa, Homo sapiens
  Payload ID: 12407
  Gene Symbol: PEX11A
  Gene Name: peroxisomal biogenesis factor 11 alpha
  ENSP ID: ENSP00000453878
MDAFTRFTNQTQGRDRLFRVQTRQCGTCYTGN

SEQ ID NO: 62047 - protein, 259 aa, Homo sapiens
  Payload ID: 12408
  Gene Symbol: PEX11B
  Gene Name: peroxisomal biogenesis factor 11 beta
  Uniprot ID: O96011
  ENSP ID: ENSP00000358312
MDAWVRFSAQSQARERLCRAAQYACSLLGHALQRHGASPELQKQIRQLESHLSLGRKLLRLGNSADALESAKRAVHLSDVVLRFCITVSHLNRALYFACDNVLWAGKSGLAPRVDQEKWAQRSFRYYLFSLIMNLSRDAYEIRLLMEQESSACSRRLKGSGGGVPGGSETGGLGGPGTPGGGLPQLALKLRLQVLLLARVLRGHPPLLLDVVRNACDLFIPLDKLGLWRCGPGIVGLCGLVSSILSILTLIYPWLRLKP

SEQ ID NO: 62048 - protein, 81 aa, Homo sapiens
  Payload ID: 12408
  Gene Symbol: PEX11B
  Gene Name: peroxisomal biogenesis factor 11 beta
  ENSP ID: ENSP00000414018
PGGGLPQLALKLRLQVLLLARVLRGHPPLLLDVVRNACDLFIPLDKLGLWRCGPGIVGLCGLVSSILSILTLIYPWLRLKP

SEQ ID NO: 62049 - protein, 245 aa, Homo sapiens
  Payload ID: 12408
  Gene Symbol: PEX11B
  Gene Name: peroxisomal biogenesis factor 11 beta
  Uniprot ID: O96011
  ENSP ID: ENSP00000437510
MGKLRAAQYACSLLGHALQRHGASPELQKQIRQLESHLSLGRKLLRLGNSADALESAKRAVHLSDVVLRFCITVSHLNRALYFACDNVLWAGKSGLAPRVDQEKWAQRSFRYYLFSLIMNLSRDAYEIRLLMEQESSACSRRLKGSGGGVPGGSETGGLGGPGTPGGGLPQLALKLRLQVLLLARVLRGHPPLLLDVVRNACDLFIPLDKLGLWRCGPGIVGLCGLVSSILSILTLIYPWLRLKP

SEQ ID NO: 62050 - protein, 241 aa, Homo sapiens
  Payload ID: 12409
  Gene Symbol: PEX11G
  Gene Name: peroxisomal biogenesis factor 11 gamma
  Uniprot ID: Q96HA9
  ENSP ID: ENSP00000221480
MASLSGLASALESYRGRDRLIRVLGYCCQLVGGVLVEQCPARSEVGTRLLVVSTQLSHCRTILRLFDDLAMFVYTKQYGLGAQEEDAFVRCVSVLGNLADQLYYPCEHVAWAADARVLHVDSSRWWTLSTTLWALSLLLGVARSLWMLLKLRQRLRSPTAPFTSPLPRGKRRAMEAQMQSEALSLLSNLADLANAVHWLPRGVLWAGRFPPWLVGLMGTISSILSMYQAARAGGQAEATTP

SEQ ID NO: 62051 - protein, 171 aa, Homo sapiens
  Payload ID: 12409
  Gene Symbol: PEX11G
  Gene Name: peroxisomal biogenesis factor 11 gamma
  Uniprot ID: Q96HA9
  ENSP ID: ENSP00000472216
MFVYTKQYGLGAQEEDAFVRCVSVLGNLADQLYYPCEHVAWAADARVLHVDSSRWWTLSTTLWALSLLLGVARSLWMLLKLRQRLRSPTAPFTSPLPRGKRRAMEAQMQSEALSLLSNLADLANAVHWLPRGVLWAGRFPPWLVGLMGTISSILSMYQAARAGGQAEATTP

SEQ ID NO: 62052 - protein, 168 aa, Homo sapiens
  Payload ID: 12409
  Gene Symbol: PEX11G
  Gene Name: peroxisomal biogenesis factor 11 gamma
  ENSP ID: ENSP00000472956
  MOD_RES (1)..(1): Any amino acid
XYRGRDRLIRVLGYCCQLVGGVLVEQCPARSEVGTRLLVVSTQLSHCRTILRLFDDLAMFVYTKQYGLGAQEEDAFVRCVSVLGNLADQLYYPCEHVAWAADARVLHVDSSRWWTLSTTLWALSLLLGVARSLWMLLKLRQRLRSPTAPFTSMYQAARAGGQAEATTP

SEQ ID NO: 62053 - protein, 359 aa, Homo sapiens
  Payload ID: 12410
  Gene Symbol: PEX12
  Gene Name: peroxisomal biogenesis factor 12
  Uniprot ID: O00623
  ENSP ID: ENSP00000225873
MAEHGAHFTAASVADDQPSIFEVVAQDSLMTAVRPALQHVVKVLAESNPTHYGFLWRWFDEIFTLLDLLLQQHYLSRTSASFSENFYGLKRIVMGDTHKSQRLASAGLPKQQLWKSIMFLVLLPYLKVKLEKLVSSLREEDEYSIHPPSSRWKRFYRAFLAAYPFVNMAWEGWFLVQQLRYILGKAQHHSPLLRLAGVQLGRLTVQDIQALEHKPAKASMMQQPARSVSEKINSALKKAVGGVALSLSTGLSVGVFFLQFLDWWYSSENQETIKSLTALPTPPPPVHLDYNSDSPLLPKMKTVCPLCRKTRVNDTVLATSGYVFCYRCVFHYVRSHQACPITGYPTEVQHLIKLYSPEN

SEQ ID NO: 62054 - protein, 221 aa, Homo sapiens
  Payload ID: 12410
  Gene Symbol: PEX12
  Gene Name: peroxisomal biogenesis factor 12
  ENSP ID: ENSP00000466280
MAEHGAHFTAASVADDQPSIFEVVAQDSLMTAVRPALQHVVKVLAESNPTHYGFLWRWFDEIFTLLDLLLQQHYLSRTSASFSENFYGLKRIVMGDTHKSQRLASAGLPKQQLWKSIMFLVLLPYLKVKLEKLVSSLREEDEYSIHPPSSRWKRFYRAFLAAYPFVNMAWEGWFLVQQLRYILGKAQHHSPLLRLAGVQLGRLTVQDIQALEHKPAKASMM

SEQ ID NO: 62055 - protein, 358 aa, Homo sapiens
  Payload ID: 12410
  Gene Symbol: PEX12
  Gene Name: peroxisomal biogenesis factor 12
  ENSP ID: ENSP00000466894
MAEHGAHFTAASVADDQPSIFEVVAQDSLMTAVRPALQHVVKVLAESNPTHYGFLWRWFDEIFTLLDLLLQQHYLSRTSASFSENFYGLKRIVMGDTHKSQRLASAGLPKQQLWKSIMFLVLLPYLKVKLEKLVSSLREEDEYSIHPPSSRWKRFYRAFLAAYPFVNMAWEGWFLVQQLRYILGKAQHHSPLLRLAGVQLGRLTVQDIQALEHKPAKASMMQQPARSVSEKINSALKKAVGGVALSLSTGLSVGVFFLQFLDWWYSSENQETIKSLTALPTPPPPVHLDYNSDSPLLPKMKTVCPLCRKTRVNDTVLATSGYVFCYRCVFHYVRSHQACPITGYPTEVQHLIKLYSPE

SEQ ID NO: 62056 - protein, 359 aa, Homo sapiens; identical to SEQ ID NO: 62053
  Payload ID: 12410
  Gene Symbol: PEX12
  Gene Name: peroxisomal biogenesis factor 12
  Uniprot ID: O00623
  ENSP ID: ENSP00000482609

SEQ ID NO: 62057 - protein, 403 aa, Homo sapiens
  Payload ID: 12411
  Gene Symbol: PEX13
  Gene Name: peroxisomal biogenesis factor 13
  Uniprot ID: Q92968
  ENSP ID: ENSP00000295030
MASQPPPPPKPWETRRIPGAGPGPGPGPTFQSADLGPTLMTRPGQPALTRVPPPILPRPSQQTGSSSVNTFRPAYSSFSSGYGAYGNSFYGGYSPYSYGYNGLGYNRLRVDDLPPSRFVQQAEESSRGAFQSIESIVHAFASVSMMMDATFSAVYNSFRAVLDVANHFSRLKIHFTKVFSAFALVRTIRYLYRRLQRMLGLRRGSENEDLWAESEGTVACLGAEDRAATSAKSWPIFLFFAVILGGPYLIWKLLSTHSDEVTDSINWASGEDDHVVARAEYDFAAVSEEEISFRAGDMLNLALKEQQPKVRGWLLASLDGQTTGLIPANYVKILGKRKGRKTVESSKVSKQQQSFTNPTLTKGATVADSLDEQEAAFESVFVETNKVPVAPDSIGKDGEKQDL

SEQ ID NO: 62058 - protein, 36 aa, Homo sapiens
  Payload ID: 12411
  Gene Symbol: PEX13
  Gene Name: peroxisomal biogenesis factor 13
  ENSP ID: ENSP00000384738
MASQPPPPPKPWETRRIPGAGPGPGPGPTFHVDFGL

SEQ ID NO: 62059 - protein, 63 aa, Homo sapiens
  Payload ID: 12411
  Gene Symbol: PEX13
  Gene Name: peroxisomal biogenesis factor 13
  ENSP ID: ENSP00000405184
MASQPPPPPKPWETRRIPGAGPGPGPGPTFQMASLSLKRRLWSVAVESGICPATASTGSKVSP

SEQ ID NO: 62060 - protein, 54 aa, Homo sapiens
  Payload ID: 12411
  Gene Symbol: PEX13
  Gene Name: peroxisomal biogenesis factor 13
  ENSP ID: ENSP00000405413
MASQPPPPPKPWETRRIPGAGPGPGPGPTFQLWSVAVESGICPATASTGSKVSP

SEQ ID NO: 62061 - protein, 377 aa, Homo sapiens
  Payload ID: 12412
  Gene Symbol: PEX14
  Gene Name: peroxisomal biogenesis factor 14
  Uniprot ID: O75381
  ENSP ID: ENSP00000349016
MASSEQAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKEDEEDEEDDDVSHVDEEDCLGVQREDRRGGDGQINEQVEKLRRPEGASNESERD

SEQ ID NO: 62062 - protein, 160 aa, Homo sapiens
  Payload ID: 12412
  Gene Symbol: PEX14
  Gene Name: peroxisomal biogenesis factor 14
  ENSP ID: ENSP00000465473
QAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTGKD

SEQ ID NO: 62063 - protein, 346 aa, Homo sapiens
  Payload ID: 12413
  Gene Symbol: PEX16
  Gene Name: peroxisomal biogenesis factor 16
  Uniprot ID: Q9Y5Y5
  ENSP ID: ENSP00000241041
MEKLRLLGLRYQEYVTRHPAATAQLETAVRGFSYLLAGRFADSHELSELVYSASNLLVLLNDGILRKELRKKLPVSLSQQKLLTWLSVLECVEVFMEMGAAKVWGEVGRWLVIALVQLAKAVLRMLLLLWFKAGLQTSPPIVPLDRETQAQPPDGDHSPGNHEQSYVGKRSNRVVRTLQNTPSLHSRHWGAPQQREGRQQQHHEELSATPTPLGLQETIAEFLYIARPLLHLLSLGLWGQRSWKPWLLAGVVDVTSLSLLSDRKGLTRRERRELRRRTILLLYYLLRSPFYDRFSEARILFLLQLLADHVPGVGLVTTSQRAASPCLPARPHTQPWSPPAFLPGHP

SEQ ID NO: 62064 - protein, 336 aa, Homo sapiens
  Payload ID: 12413
  Gene Symbol: PEX16
  Gene Name: peroxisomal biogenesis factor 16
  Uniprot ID: Q9Y5Y5
  ENSP ID: ENSP00000368024
MEKLRLLGLRYQEYVTRHPAATAQLETAVRGFSYLLAGRFADSHELSELVYSASNLLVLLNDGILRKELRKKLPVSLSQQKLLTWLSVLECVEVFMEMGAAKVWGEVGRWLVIALVQLAKAVLRMLLLLWFKAGLQTSPPIVPLDRETQAQPPDGDHSPGNHEQSYVGKRSNRVVRTLQNTPSLHSRHWGAPQQREGRQQQHHEELSATPTPLGLQETIAEFLYIARPLLHLLSLGLWGQRSWKPWLLAGVVDVTSLSLLSDRKGLTRRERRELRRRTILLLYYLLRSPFYDRFSEARILFLLQLLADHVPGVGLVTRPLMDYLPTWQKIYFYSWG

SEQ ID NO: 62065 - protein, 52 aa, Homo sapiens
  Payload ID: 12413
  Gene Symbol: PEX16
  Gene Name: peroxisomal biogenesis factor 16
  ENSP ID: ENSP00000431132
MEKLRLLGLRYQEYVTRHPAATAQLETAVRGFSYLLAGATLTFDQFLLGPDL

SEQ ID NO: 62066 - protein, 160 aa, Homo sapiens
  Payload ID: 12413
  Gene Symbol: PEX16
  Gene Name: peroxisomal biogenesis factor 16
  ENSP ID: ENSP00000431309
MEMGAAKVWGEVGRWLVIALVQLAKAVLRMLLLLWFKAGLQTSPPIVPLDRETQAQPPDGDHSPGNHEQSYVGKRSNRVVRTLQNTPSLHSRHWGAPQQREGRQQQHHEELSATPTPLGLQETIAEFLYIARPLLHLLSLGLWGQRSWKPWLLAGVVDVT

SEQ ID NO: 62067 - protein, 60 aa, Homo sapiens
  Payload ID: 12413
  Gene Symbol: PEX16
  Gene Name: peroxisomal biogenesis factor 16
  ENSP ID: ENSP00000432486
MEKLRLLGLRYQEYVTRHPAATAQLETAVRGFSYLLAGRFADSHELSELGRSSVRLENSH

SEQ ID NO: 62068 - protein, 183 aa, Homo sapiens
  Payload ID: 12413
  Gene Symbol: PEX16
  Gene Name: peroxisomal biogenesis factor 16
  ENSP ID: ENSP00000433045
MEKLRLLGLRYQEYVTRHPAATAQLETAVRGFSYLLAGRFADSHELSELDGDHSPGNHEQSYVGKRSNRVVRTLQNTPSLHSRHWGAPQQREGRQQQHHEELSATPTPLGLQETIAEFLYIARPLLHLLSLGLWGQRSWKPWLLAGVVDVTSLSLLSDRKGLTRRERRELRRRTILLLYYLLR

SEQ ID NO: 62069 - protein, 64 aa, Homo sapiens
  Payload ID: 12413
  Gene Symbol: PEX16
  Gene Name: peroxisomal biogenesis factor 16
  ENSP ID: ENSP00000434060
MEKLRLLGLRYQESIRRFARAVRAGKKLSEVREQSLMVPEPRFKSRSPRFQDSQIVTTSRVFAQ

SEQ ID NO: 62070 - protein, 241 aa, Homo sapiens
  Payload ID: 12413
  Gene Symbol: PEX16
  Gene Name: peroxisomal biogenesis factor 16
  ENSP ID: ENSP00000434654
MEMGAAKVWGEVGRWLVIALVQLAKAVLRMLLLLWFKAGLQTSPPIVPLDRETQAQPPDGDHSPGNHEQSYVGKRSNRVVRTLQNTPSLHSRHWGAPQQREGRQQQHHEELSATPTPLGLQETIAEFLYIARPLLHLLSLGLWGQRSWKPWLLAGVVDVTSLSLLSDRKGLTRRERRELRRRTILLLYYLLRSPFYDRFSEARILFLLQLLADHVPGVGLVTRPLMDYLPTWQKIYFYSWG

SEQ ID NO: 62071 - protein, 299 aa, Homo sapiens
  Payload ID: 12414
  Gene Symbol: PEX19
  Gene Name: peroxisomal biogenesis factor 19
  Uniprot ID: P40855
  ENSP ID: ENSP00000357051
MAAAEEGCSVGAEADRELEELLESALDDFDKAKPSPAPPSTTTAPDASGPQKRSPGDTAKDALFASQEKFFQELFDSELASQATAEFEKAMKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMPPGLNFDLDALNLSGPPGASGEQCLIM

SEQ ID NO: 62072 - protein, 235 aa, Homo sapiens
  Payload ID: 12414
  Gene Symbol: PEX19
  Gene Name: peroxisomal biogenesis factor 19
  ENSP ID: ENSP00000376054
MESGALDDFDKAKPSPAPPSTTTAPDASGPQKRSPGDTAKDALFASQEKFFQELFDSELASQATAEFEKAMKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLM

SEQ ID NO: 62073 - protein, 119 aa, Homo sapiens
  Payload ID: 12414
  Gene Symbol: PEX19
  Gene Name: peroxisomal biogenesis factor 19
  ENSP ID: ENSP00000434567
  MOD_RES (1)..(1): Any amino acid
XEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMVSMSYFSRF

SEQ ID NO: 62074 - protein, 40 aa, Homo sapiens
  Payload ID: 12414
  Gene Symbol: PEX19
  Gene Name: peroxisomal biogenesis factor 19
  ENSP ID: ENSP00000434633
MAAAEEGCSVGAEADRELEELLERCPLRFPREVFPGTIRQ

SEQ ID NO: 62075 - protein, 166 aa, Homo sapiens
  Payload ID: 12414
  Gene Symbol: PEX19
  Gene Name: peroxisomal biogenesis factor 19
  ENSP ID: ENSP00000435896
MESGALDDFDKAKPSPAPPSTTTAPDASGPQKRSPGDTAKDALFASQEKFFQELFDSELASQATAEFEKAMKELAEEEPHLVEQFQKLSEAAGRVELQHVGRRADQGHGGARHGRRGWGREHPPHHAEYYAEPTLQGCAVPITEGDHRKVSRMVAESSGISTSRAV

SEQ ID NO: 62076 - protein, 186 aa, Homo sapiens
  Payload ID: 12414
  Gene Symbol: PEX19
  Gene Name: peroxisomal biogenesis factor 19
  ENSP ID: ENSP00000435915
MAAAEEGCSVGAEADRELEELLESALDDFDKAKPSPAPPSTTTAPDASGPQKRSPGDTAKDALFASQEKFFQELFDSELASQATAEFEKAMKELAEEEPHLVEQFQKLSEAAGRVELQHVGRRADQGHGGARHGRRGWGREHPPHHAEYYAEPTLQGCAVPITEGDHRKVSRMVAESSGISTSRAV

SEQ ID NO: 62077 - protein, 305 aa, Homo sapiens
  Payload ID: 12415
  Gene Symbol: PEX2
  Gene Name: peroxisomal biogenesis factor 2
  Uniprot ID: P28328
  ENSP ID: ENSP00000349543
MASRKENAKSANRVLRISQLDALELNKALEQLVWSQFTQCFHGFKPGLLARFEPEVKACLWVFLWRFTIYSKNATVGQSVLNIKYKNDFSPNLRYQPPSKNQKIWYAVCTIGGRWLEERCYDLFRNHHLASFGKVKQCVNFVIGLLKLGGLINFLIFLQRGKFATLTERLLGIHSVFCKPQNICEVGFEYMNRELLWHGFAEFLIFLLPLINVQKLKAKLSSWCIPLTGAPNSDNTLATSGKECALCGEWPTMPHTIGCEHIFCYFCAKSSFLFDVYFTCPKCGTEVHSLQPLKSGIEMSEVNAL

SEQ ID NO: 62078 - protein, 305 aa, Homo sapiens; identical to SEQ ID NO: 62077
  Payload ID: 12415
  Gene Symbol: PEX2
  Gene Name: peroxisomal biogenesis factor 2
  Uniprot ID: P28328
  ENSP ID: ENSP00000428590

SEQ ID NO: 62079 - protein, 305 aa, Homo sapiens; identical to SEQ ID NO: 62077
  Payload ID: 12415
  Gene Symbol: PEX2
  Gene Name: peroxisomal biogenesis factor 2
  Uniprot ID: P28328
  ENSP ID: ENSP00000428638

SEQ ID NO: 62080 - protein, 179 aa, Homo sapiens
  Payload ID: 12415
  Gene Symbol: PEX2
  Gene Name: peroxisomal biogenesis factor 2
  ENSP ID: ENSP00000429304
MASRKENAKSANRVLRISQLDALELNKALEQLVWSQFTQCFHGFKPGLLARFEPEVKACLWVFLWRFTIYSKNATVGQSVLNIKYKNDFSPNLRYQPPSKNQKIWYAVCTIGGRWLEERCYDLFRNHHLASFGKVKQCVNFVIGLLKLGGLINFLIFLQRGKFATLTERLLGIHSVFCK

SEQ ID NO: 62081 - protein, 3 aa, Homo sapiens
  Payload ID: 12415
  Gene Symbol: PEX2
  Gene Name: peroxisomal biogenesis factor 2
  ENSP ID: ENSP00000429740
MAS

SEQ ID NO: 62082 - protein, 305 aa, Homo sapiens
  Payload ID: 12416
  Gene Symbol: PEX26
  Gene Name: peroxisomal biogenesis factor 26
  Uniprot ID: Q7Z412
  ENSP ID: ENSP00000331106
MKSDSSTSAAPLRGLGGPLRSSEPVRAVPARAPAVDLLEEAADLLVVHLDFRAALETCERAWQSLANHAVAEEPAGTSLEVKCSLCVVGIQALAEMDRWQEVLSWVLQYYQVPEKLPPKVLELCILLYSKMQEPGAVLDVVGAWLQDPANQNLPEYGALAEFHVQRVLLPLGCLSEAEELVVGSAAFGEERRLDVLQAIHTARQQQKQEHSGSEEAQKPNLEGSVSHKFLSLPMLVRQLWDSAVSHFFSLPFKKSLLAALILCLLVVRFDPASPSSLHFLYKLAQLFRWIRKAAFSRLYQLRIRD

SEQ ID NO: 62083 - protein, 305 aa, Homo sapiens; identical to SEQ ID NO: 62082
  Payload ID: 12416
  Gene Symbol: PEX26
  Gene Name: peroxisomal biogenesis factor 26
  Uniprot ID: Q7Z412
  ENSP ID: ENSP00000382648

SEQ ID NO: 62084 - protein, 256 aa, Homo sapiens
  Payload ID: 12416
  Gene Symbol: PEX26
  Gene Name: peroxisomal biogenesis factor 26
  Uniprot ID: Q7Z412
  ENSP ID: ENSP00000412441
MKSDSSTSAAPLRGLGGPLRSSEPVRAVPARAPAVDLLEEAADLLVVHLDFRAALETCERAWQSLANHAVAEEPAGTSLEVKCSLCVVGIQALAEMDRWQEVLSWVLQYYQVPEKLPPKVLELCILLYSKMQEPGAVLDVVGAWLQDPANQNLPEYGALAEFHVQRVLLPLGCLSEAEELVVGSAAFGEERRLDVLQAIHTARQQQKQEHSGSEEAQKPNLEASPSSLHFLYKLAQLFRWIRKAAFSRLYQLRIRD

SEQ ID NO: 62085 - protein, 189 aa, Homo sapiens
  Payload ID: 12416
  Gene Symbol: PEX26
  Gene Name: peroxisomal biogenesis factor 26
  ENSP ID: ENSP00000434235
MKSDSSTSAAPLRGLGGPLRSSEPVRAVPARAPAVDLLEEAADLLVVHLDFRAALETCERAWQSLANHAVAEEPAGTSLEVKCSLCVVGIQALAEMDRWQEVLSWVLQYYQVPEKLPPKVLELCGNAYQSTWAKREFRLAMPAGSSSAWNTASRQTALLMLKLARSTMMTPSPPFSARLAMGSMCPGPS

SEQ ID NO: 62086 - protein, 256 aa, Homo sapiens; identical to SEQ ID NO: 62084
  Payload ID: 12416
  Gene Symbol: PEX26
  Gene Name: peroxisomal biogenesis factor 26
  Uniprot ID: Q7Z412
  ENSP ID: ENSP00000482091

SEQ ID NO: 62087 - protein, 373 aa, Homo sapiens
  Payload ID: 12417
  Gene Symbol: PEX3
  Gene Name: peroxisomal biogenesis factor 3
  Uniprot ID: P56589
  ENSP ID: ENSP00000356563
MLRSVWNFLKRHKKKCIFLGTVLGGVYILGKYGQKKIREIQEREAAEYIAQARRQYHFESNQRTCNMTVLSMLPTLREALMQQLNSESLTALLKNRPSNKLEIWEDLKIISFTRSTVAVYSTCMLVVLLRVQLNIIGGYIYLDNAAVGKNGTTILAPPDVQQQYLSSIQHLLGDGLTELITVIKQAVQKVLGSVSLKHSLSLLDLEQKLKEIRNLVEQHKSSSWINKDGSKPLLCHYMMPDEETPLAVQACGLSPRDITTIKLLNETRDMLESPDFSTVLNTCLNRGFSRLLDNMAEFFRPTEQDLQHGNSMNSLSSVSLPLAKIIPIVNGQIHSVCSETPSHFVQDLLTMEQVKDFAANVYEAFSTPQQLEK

SEQ ID NO: 62088 - protein, 182 aa, Homo sapiens
  Payload ID: 12417
  Gene Symbol: PEX3
  Gene Name: peroxisomal biogenesis factor 3
  ENSP ID: ENSP00000356564
MLRSVWNFLKRHKKKCIFLGTVLGVLSMLPTLREALMQQLNSESLTALLKNRPSNKLEIWEDLKIISFTRSTVAVYSTCMLVVLLRVQLNIIGGYIYLDNAAVGKNGTTILAPPDVQQQYLSSIQHLLGDGLTELITVIKQAVQKVLGSVSLKHSLSLLDLEQKLKEIRNLVEQHKSSSWIN

SEQ ID NO: 62089 - protein, 602 aa, Homo sapiens
  Payload ID: 12418
  Gene Symbol: PEX5
  Gene Name: peroxisomal biogenesis factor 5
  Uniprot ID: P50542
  ENSP ID: ENSP00000266563
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 62090 - protein, 631 aa, Homo sapiens
  Payload ID: 12418
  Gene Symbol: PEX5
  Gene Name: peroxisomal biogenesis factor 5
  Uniprot ID: P50542
  ENSP ID: ENSP00000266564
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEFLKFVRQIGEGQVSLESGAGSGRAQAEQWAAEFIQQQGTSDAWVDQFTRPVNTSALDMEFERAKSAIELQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 62091 - protein, 410 aa, Homo sapiens
  Payload ID: 12418
  Gene Symbol: PEX5
  Gene Name: peroxisomal biogenesis factor 5
  ENSP ID: ENSP00000379877
MAMRELVEAECGGANPLMKLAGHFTQDKALRQEGLRPGPWPPGAPASEAVSVLEVESPGAASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEGTSDAWVDQFTRPVNTSALDMEFERAKSAIELQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLV

SEQ ID NO: 62092 - protein, 660 aa, Homo sapiens
  Payload ID: 12418
  Gene Symbol: PEX5
  Gene Name: peroxisomal biogenesis factor 5
  ENSP ID: ENSP00000391601
MLLCRAHRVLGLRGARELAVTMAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEFLKFVRQIGEGQVSLESGAGSGRAQAEQWAAEFIQQQGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 62093 - protein, 639 aa, Homo sapiens
  Payload ID: 12418
  Gene Symbol: PEX5
  Gene Name: peroxisomal biogenesis factor 5
  Uniprot ID: P50542
  ENSP ID: ENSP00000400647
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEFLKFVRQIGEGQVSLESGAGSGRAQAEQWAAEFIQQQGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 62094 - protein, 654 aa, Homo sapiens
  Payload ID: 12418
  Gene Symbol: PEX5
  Gene Name: peroxisomal biogenesis factor 5
  Uniprot ID: P50542
  ENSP ID: ENSP00000407401
MAMRELVEAECGGANPLMKLAGHFTQDKALRQEGLRPGPWPPGAPASEAVSVLEVESPGAASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEFLKFVRQIGEGQVSLESGAGSGRAQAEQWAAEFIQQQGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 62095 - protein, 639 aa, Homo sapiens; identical to SEQ ID NO: 62093
  Payload ID: 12418
  Gene Symbol: PEX5
  Gene Name: peroxisomal biogenesis factor 5
  Uniprot ID: P50542
  ENSP ID: ENSP00000410159

SEQ ID NO: 62096 - protein, 168 aa, Homo sapiens
  Payload ID: 12418
  Gene Symbol: PEX5
  Gene Name: peroxisomal biogenesis factor 5
  ENSP ID: ENSP00000437938
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTVLTRSRYDEYHPEEDLQHT

SEQ ID NO: 62097 - protein, 102 aa, Homo sapiens
  Payload ID: 12418
  Gene Symbol: PEX5
  Gene Name: peroxisomal biogenesis factor 5
  ENSP ID: ENSP00000438494
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQA

SEQ ID NO: 62098 - protein, 118 aa, Homo sapiens
  Payload ID: 12418
  Gene Symbol: PEX5
  Gene Name: peroxisomal biogenesis factor 5
  ENSP ID: ENSP00000438772
MDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDF

SEQ ID NO: 62099 - protein, 248 aa, Homo sapiens
  Payload ID: 12418
  Gene Symbol: PEX5
  Gene Name: peroxisomal biogenesis factor 5
  ENSP ID: ENSP00000439025
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEFLKFVRQIGEGQVSLESGAGSGRAQAEQWAAEFI

SEQ ID NO: 62100 - protein, 128 aa, Homo sapiens
  Payload ID: 12418
  Gene Symbol: PEX5
  Gene Name: peroxisomal biogenesis factor 5
  ENSP ID: ENSP00000440711
MDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLA

SEQ ID NO: 62101 - protein, 104 aa, Homo sapiens
  Payload ID: 12418
  Gene Symbol: PEX5
  Gene Name: peroxisomal biogenesis factor 5
  ENSP ID: ENSP00000440833
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQ

SEQ ID NO: 62102 - protein, 115 aa, Homo sapiens
  Payload ID: 12418
  Gene Symbol: PEX5
  Gene Name: peroxisomal biogenesis factor 5
  ENSP ID: ENSP00000441553
MDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTA

SEQ ID NO: 62103 - protein, 272 aa, Homo sapiens
  Payload ID: 12418
  Gene Symbol: PEX5
  Gene Name: peroxisomal biogenesis factor 5
  ENSP ID: ENSP00000443500
MAMRELVEAECGGANPLMKLAGHFTQDKALRQEGLRPGPWPPGAPASEALVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEGTSDAWVDQFTRPVNTSALDMEFERAKSAIESDVDFWDKLQAELEEMAKRDAEAHPWLSDYDDLTSATYD

SEQ ID NO: 62104 - protein, 31 aa, Homo sapiens
  Payload ID: 12418
  Gene Symbol: PEX5
  Gene Name: peroxisomal biogenesis factor 5
  ENSP ID: ENSP00000444787
  MOD_RES (1)..(1): Any amino acid
XALSMLGQSDAYGAADARDLSTLLTMFGLPQ

SEQ ID NO: 62105 - protein, 114 aa, Homo sapiens
  Payload ID: 12418
  Gene Symbol: PEX5
  Gene Name: peroxisomal biogenesis factor 5
  ENSP ID: ENSP00000445630
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLAL

SEQ ID NO: 62106 - protein, 624 aa, Homo sapiens
  Payload ID: 12419
  Gene Symbol: PEX5L
  Gene Name: peroxisomal biogenesis factor 5-like
  Uniprot ID: Q8IYB4
  ENSP ID: ENSP00000263962
MYQGHMQVVGVTLKKKWHCLQKSDLTLALGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 62107 - protein, 518 aa, Homo sapiens
  Payload ID: 12419
  Gene Symbol: PEX5L
  Gene Name: peroxisomal biogenesis factor 5-like
  Uniprot ID: Q8IYB4
  ENSP ID: ENSP00000376420
MVMKEIPREESAEEKPLLTMTSQLVNEQQESRPLLSPSIDDFLCETKSEAIARPVTSNTADIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 62108 - protein, 518 aa, Homo sapiens; identical to SEQ ID NO: 62107
  Payload ID: 12419
  Gene Symbol: PEX5L
  Gene Name: peroxisomal biogenesis factor 5-like
  Uniprot ID: Q8IYB4
  ENSP ID: ENSP00000417270

SEQ ID NO: 62109 - protein, 194 aa, Homo sapiens
  Payload ID: 12419
  Gene Symbol: PEX5L
  Gene Name: peroxisomal biogenesis factor 5-like
  ENSP ID: ENSP00000417438
MSDSEMDGRTHIPSLLNALLSRNRVMQMSYLKSKEQGYGKLSSDEDLEIIVDQKQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGS

SEQ ID NO: 62110 - protein, 567 aa, Homo sapiens
  Payload ID: 12419
  Gene Symbol: PEX5L
  Gene Name: peroxisomal biogenesis factor 5-like
  Uniprot ID: Q8IYB4
  ENSP ID: ENSP00000418054
MYQGHMQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 62111 - protein, 591 aa, Homo sapiens
  Payload ID: 12419
  Gene Symbol: PEX5L
  Gene Name: peroxisomal biogenesis factor 5-like
  Uniprot ID: Q8IYB4
  ENSP ID: ENSP00000418440
MYQGHMQKSKEQGYGKLSSDEDLEIIVDQKQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 62112 - protein, 434 aa, Homo sapiens
  Payload ID: 12419
  Gene Symbol: PEX5L
  Gene Name: peroxisomal biogenesis factor 5-like
  Uniprot ID: Q8IYB4
  ENSP ID: ENSP00000418665
MAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 62113 - protein, 70 aa, Homo sapiens
  Payload ID: 12419
  Gene Symbol: PEX5L
  Gene Name: peroxisomal biogenesis factor 5-like
  ENSP ID: ENSP00000418746
MAERKSSSSRTGSKELLWSSEHRSQPELSGGKSALNSESASELELVAPTQARLTKEHRWGSALLSRNHSL

SEQ ID NO: 62114 - protein, 602 aa, Homo sapiens
  Payload ID: 12419
  Gene Symbol: PEX5L
  Gene Name: peroxisomal biogenesis factor 5-like
  Uniprot ID: Q8IYB4
  ENSP ID: ENSP00000419348
MYQGHMQGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 62115 - protein, 203 aa, Homo sapiens
  Payload ID: 12419
  Gene Symbol: PEX5L
  Gene Name: peroxisomal biogenesis factor 5-like
  ENSP ID: ENSP00000419406
MSDSEMDGRTHIPSLLNALLSRNRVMQMSYLKSKEQGYGKLSSDEDLEIIVDQKQGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDD

SEQ ID NO: 62116 - protein, 34 aa, Homo sapiens
  Payload ID: 12419
  Gene Symbol: PEX5L
  Gene Name: peroxisomal biogenesis factor 5-like
  ENSP ID: ENSP00000419790
MAERKSSSSRTGSKELLWSSEHRSQPELSGGKSA

SEQ ID NO: 62117 - protein, 626 aa, Homo sapiens
  Payload ID: 12419
  Gene Symbol: PEX5L
  Gene Name: peroxisomal biogenesis factor 5-like
  Uniprot ID: Q8IYB4
  ENSP ID: ENSP00000419975
MYQGHMQKSKEQGYGKLSSDEDLEIIVDQKQGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 62118 - protein, 583 aa, Homo sapiens
  Payload ID: 12419
  Gene Symbol: PEX5L
  Gene Name: peroxisomal biogenesis factor 5-like
  Uniprot ID: Q8IYB4
  ENSP ID: ENSP00000420555
MVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 62119 - protein, 738 aa, Homo sapiens
  Payload ID: 12420
  Gene Symbol: PEX6
  Gene Name: peroxisomal biogenesis factor 6
  Uniprot ID: Q13608
  ENSP ID: ENSP00000244546
MALAVLRVLEPFPTETPPLAVLLPPGGPWPAAELGLVLALRPAGESPAGPALLVAALEGPDAGTEEQGPGPPQLLVSRALLRLLALGSGAWVRARAVRRPPALGWALLGTSLGPGLGPRVGPLLVRRGETLPVPGPRVLETRPALQGLLGPGTRLAVTELRGRARLCPESGDSSRPPPPPVVSSFAVSGTVRRLQGVLGGTGDSLGVSRSCLRGLGLFQGEWVWVAQARESSNTSQPHLARVQVLEPRWDLSDRLGPGSGPLGEPLADGLALVPATLAFNLGCDPLEMGELRIQRYLEGSIAPEDKGSCSLLPGPPFARELHIEIVSSPHYSTNGNYDGVLYRHFQIPRVVQEGDVLCVPTIGQVEILEGSPEKLPRWREMFFKVKKTVGEAPDGPASAYLADTTHTSLYMVGSTLSPVPWLPSEESTLWSSLSPPGLEALVSELCAVLKPRLQPGGALLTGTSSVLLRGPPGCGKTTVVAAACSHLGLHLLKVPCSSLCAESSGAVETKLQAIFSRARRCRPAVLLLTAVDLLGRDRDGLGEDARVMAVLRHLLLNEDPLNSCPPLMVVATTSRAQDLPADVQTAFPHELEVPALSEGQRLSILRALTAHLPLGQEVNLAQLARRCAGFVVGDLYALLTHSSRAACTRIKNSGLAGGLTEEDEGELCAAGFPLLAEDFGQALEQLQTAHSQAVGAPKVETKSLECLPGPGLQLHALSSLMNWTLWPQAGGEVEILEE

SEQ ID NO: 62120 - protein, 980 aa, Homo sapiens
  Payload ID: 12420
  Gene Symbol: PEX6
  Gene Name: peroxisomal biogenesis factor 6
  Uniprot ID: Q13608
  ENSP ID: ENSP00000303511
MALAVLRVLEPFPTETPPLAVLLPPGGPWPAAELGLVLALRPAGESPAGPALLVAALEGPDAGTEEQGPGPPQLLVSRALLRLLALGSGAWVRARAVRRPPALGWALLGTSLGPGLGPRVGPLLVRRGETLPVPGPRVLETRPALQGLLGPGTRLAVTELRGRARLCPESGDSSRPPPPPVVSSFAVSGTVRRLQGVLGGTGDSLGVSRSCLRGLGLFQGEWVWVAQARESSNTSQPHLARVQVLEPRWDLSDRLGPGSGPLGEPLADGLALVPATLAFNLGCDPLEMGELRIQRYLEGSIAPEDKGSCSLLPGPPFARELHIEIVSSPHYSTNGNYDGVLYRHFQIPRVVQEGDVLCVPTIGQVEILEGSPEKLPRWREMFFKVKKTVGEAPDGPASAYLADTTHTSLYMVGSTLSPVPWLPSEESTLWSSLSPPGLEALVSELCAVLKPRLQPGGALLTGTSSVLLRGPPGCGKTTVVAAACSHLGLHLLKVPCSSLCAESSGAVETKLQAIFSRARRCRPAVLLLTAVDLLGRDRDGLGEDARVMAVLRHLLLNEDPLNSCPPLMVVATTSRAQDLPADVQTAFPHELEVPALSEGQRLSILRALTAHLPLGQEVNLAQLARRCAGFVVGDLYALLTHSSRAACTRIKNSGLAGGLTEEDEGELCAAGFPLLAEDFGQALEQLQTAHSQAVGAPKIPSVSWHDVGGLQEVKKEILETIQLPLEHPELLSLGLRRSGLLLHGPPGTGKTLLAKAVATECSLTFLSVKGPELINMYVGQSEENVREVFARARAAAPCIIFFDELDSLAPSRGRSGDSGGVMDRVVSQLLAELDGLHSTQDVFVIGATNRPDLLDPALLRPGRFDKLVFVGANEDRASQLRVLSAITRKFKLEPSVSLVNVLDCCPPQLTGADLYSLCSDAMTAALKRRVHDLEEGLEPGSSALMLTMEDLLQAAARLQPSVSEQELLRYKRIQRKFAAC

SEQ ID NO: 62121 - protein, 323 aa, Homo sapiens
  Payload ID: 12421
  Gene Symbol: PEX7
  Gene Name: peroxisomal biogenesis factor 7
  Uniprot ID: O00628
  ENSP ID: ENSP00000315680
MSAVCGGAARMLRTPGRHGYAAEFSPYLPGRLACATAQHYGIAGCGTLLILDPDEAGLRLFRSFDWNDGLFDVTWSENNEHVLITCSGDGSLQLWDTAKAAGPLQVYKEHAQEVYSVDWSQTRGEQLVVSGSWDQTVKLWDPTVGKSLCTFRGHESIIYSTIWSPHIPGCFASASGDQTLRIWDVKAAGVRIVIPAHQAEILSCDWCKYNENLLVTGAVDCSLRGWDLRNVRQPVFELLGHTYAIRRVKFSPFHASVLASCSYDFTVRFWNFSKPDSLLETVEHHTEFTCGLDFSLQSPTQVADCSWDETIKIYDPACLTIPA

SEQ ID NO: 62122 - protein, 122 aa, Homo sapiens
  Payload ID: 12421
  Gene Symbol: PEX7
  Gene Name: peroxisomal biogenesis factor 7
  ENSP ID: ENSP00000356730
MSAVCGGAARMLRTPGRHGYAAEFSPYLPGRLACATAQHYGIAGCGTLLILDPDEAGLRLFRSFDWNDGLFDVTWSENNEHVLITCSGDGSLQLWDTAKAAGPLQVYKEHAQEYVQGSCVVK

SEQ ID NO: 62123 - protein, 280 aa, Homo sapiens
  Payload ID: 12421
  Gene Symbol: PEX7
  Gene Name: peroxisomal biogenesis factor 7
  Uniprot ID: O00628
  ENSP ID: ENSP00000441004
MSAVCGGAARMLRTPGRHGYAAEFSPYLPGRLACATAQHYGIAGCGTLLILDPDEAGLRLFRSFDWNDGLFDVTWSENNEHVLITCSGDGSLQLWDTAKAAGPLQVYKEHAQEVYSVDWSQTRGEQLVVSGSWDQTVKLWDPTVGKSLCTFRGHESIIYSTIWSPHIPGCFASASGDQTLRIWDVKAAGVRIVIPAHQAEILSCDWCKYNENLLVTGAVDCSLRGWDLRNVRQPVFELLGHTYAIRRVKMESCPVTQTRSQLTATSAFWVQAVLLPQPTE

SEQ ID NO: 62124 - protein, 195 aa, Homo sapiens
  Payload ID: 12422
  Gene Symbol: PXMP2
  Gene Name: peroxisomal membrane protein 2, 22kDa
  Uniprot ID: Q9NR77
  ENSP ID: ENSP00000321271
MAPAASRLRAEAGLGALPRRALAQYLLFLRLYPVLTKAATSGILSALGNFLAQMIEKKRKKENSRSLDVGGPLRYAVYGFFFTGPLSHFFYFFMEHWIPPEVPLAGLRRLLLDRLVFAPAFLMLFFLIMNFLEGKDASAFAAKMRGGFWPALRMNWRVWTPLQFININYVPLKFRVLFANLAALFWYAYLASLGK

SEQ ID NO: 62125 - protein, 227 aa, Homo sapiens
  Payload ID: 12422
  Gene Symbol: PXMP2
  Gene Name: peroxisomal membrane protein 2, 22kDa
  ENSP ID: ENSP00000398708
  MOD_RES (1)..(1): Any amino acid
XRKKENSRSLDVGGPLRYAVYGFFFTGPLSHFFYFFMEHWIPPEVPLAGLRRLLLDRLVFAPAFLMLFFLIMNFLEGKDASAFAAKMRGGFWPALRMNWRVWTPLQFININYVPLKPGSPGPLPHWEDGVQHPLQHGRIPPDATGGGLAEPAGATCFPPPEVPGALRQPGSSVLVCLPGLLGEVTTAGRTSGALWTWVWGSHPPSESRTNPVRMSLTLNQVIQDAQK

SEQ ID NO: 62126 - protein, 49 aa, Homo sapiens
  Payload ID: 12422
  Gene Symbol: PXMP2
  Gene Name: peroxisomal membrane protein 2, 22kDa
  ENSP ID: ENSP00000444486
  MOD_RES (1)..(1): Any amino acid
XGILSALGNFLAQMIEKKRKKENSRSLDVGGPLRYAVYGGKTPQPSPPR

SEQ ID NO: 62127 - protein, 160 aa, Homo sapiens
  Payload ID: 12422
  Gene Symbol: PXMP2
  Gene Name: peroxisomal membrane protein 2, 22kDa
  ENSP ID: ENSP00000446049
MAPAASRLRAEAGLGALPRRALAQYLLFLRLYPVLTKAATSGILSALGNFLAQMIEKKRKKENSRSLDVGGPLRYAVYGSGCSSPTWQLCSGMPTWPPWGSDDRWENIRCTVDVGLGVSPAQREQNQSSQDVTDSKSGDSRCPKMMDRETEISECQNPVF

SEQ ID NO: 62128 - protein, 83 aa, Homo sapiens
  Payload ID: 12422
  Gene Symbol: PXMP2
  Gene Name: peroxisomal membrane protein 2, 22kDa
  ENSP ID: ENSP00000484702
PEVPLAGLRRLLLDRLVFAPAFLMLFFLIMNFLEGKDASAFAAKMRGGFWPALRMNWRVWTPLQFININYVPLKVRATGLSLC

SEQ ID NO: 62129 - protein, 144 aa, Homo sapiens
  Payload ID: 12423
  Gene Symbol: PXMP4
  Gene Name: peroxisomal membrane protein 4, 24kDa
  ENSP ID: ENSP00000217398
MAAPPQLRALLVVVNALLRKRRYHAALAVLKGFRNGAVYGAKIRAPHALVMTFLFRNGRGTCVCAASRRSCGPYCRPHISTPGTWHGLCSPTRVSVPCSPTYKARPTQHTHSWRPSSGVSWCLEKTITSTARSTCTCCHASCLP

SEQ ID NO: 62130 - protein, 71 aa, Homo sapiens
  Payload ID: 12423
  Gene Symbol: PXMP4
  Gene Name: peroxisomal membrane protein 4, 24kDa
  Uniprot ID: Q9Y6I8
  ENSP ID: ENSP00000343071
MAAPPQLRALLVVVNALLRKRRYHAALAVLKGFRNGAVYGAKIRAPHALVMTFLFRNGRSTCTCCHASCLP

SEQ ID NO: 62131 - protein, 212 aa, Homo sapiens
  Payload ID: 12423
  Gene Symbol: PXMP4
  Gene Name: peroxisomal membrane protein 4, 24kDa
  Uniprot ID: Q9Y6I8
  ENSP ID: ENSP00000386385
MAAPPQLRALLVVVNALLRKRRYHAALAVLKGFRNGAVYGAKIRAPHALVMTFLFRNGSLQEKLWAILQATYIHSWNLARFVFTYKGLRALQSYIQGKTYPAHAFLAAFLGGILVFGENNNINSQINMYLLSRVLFALSRLAVEKGYIPEPRWDPFPLLTAVVWGLVLWLFEYHRSTLQPSLQSSMTYLYEDSNVWHDISDFLVYNKSRPSN

SEQ ID NO: 62132 - protein, 303 aa, Homo sapiens
  Payload ID: 12424
  Gene Symbol: PECR
  Gene Name: peroxisomal trans-2-enoyl-CoA reductase
  Uniprot ID: Q9BY49
  ENSP ID: ENSP00000265322
MASWAKGRSYLAPGLLQGQVAIVTGGATGIGKAIVKELLELGSNVVIASRKLERLKSAADELQANLPPTKQARVIPIQCNIRNEEEVNNLVKSTLDTFGKINFLVNNGGGQFLSPAEHISSKGWHAVLETNLTGTFYMCKAVYSSWMKEHGGSIVNIIVPTKAGFPLAVHSGAARAGVYNLTKSLALEWACSGIRINCVAPGVIYSQTAVENYGSWGQSFFEGSFQKIPAKRIGVPEEVSSVVCFLLSPAASFITGQSVDVDGGRSLYTHSYEVPDHDNWPKGAGDLSVVKKMKETFKEKAKL

SEQ ID NO: 62133 - protein, 157 aa, Homo sapiens
  Payload ID: 12424
  Gene Symbol: PECR
  Gene Name: peroxisomal trans-2-enoyl-CoA reductase
  ENSP ID: ENSP00000395512
MASWAKGRSYLAPGLLQGQVAIVTGGATGIGKAIVKELLELGSNVVIASRKLERLKSAADELQANLPPTKQARVIPIQCNIRNEEEVNNLVKSTLDTFGKINFLVNNGGGQFLSPAEHISSKGWHAVLETNLTGTFYMCKAGILELQEQVFTTSPNL

SEQ ID NO: 62134 - protein, 134 aa, Homo sapiens
  Payload ID: 12425
  Gene Symbol: PXT1
  Gene Name: peroxisomal, testis specific 1
  Uniprot ID: Q8NFP0
  ENSP ID: ENSP00000419944
MKKKHDGIVYETKEVLNPSPKVTHCCKSLWLKYSFQKAYMTQLVSSQPVPAMSRNPDHNLLSQPKEHSIVQKHHQEEIIHKLAMQLRHIGDNIDHRMVREDLQQDGRDALDHFVFFFFRRVQVLLHFFWNNHLL

SEQ ID NO: 62135 - protein, 51 aa, Homo sapiens
  Payload ID: 12425
  Gene Symbol: PXT1
  Gene Name: peroxisomal, testis specific 1
  ENSP ID: ENSP00000480598
MQLRHIGDNIDHRMVREDLQQDGRDALDHFVFFFFRRVQVLLHFFWNNHLL

SEQ ID NO: 62136 - protein, 468 aa, Homo sapiens
  Payload ID: 12426
  Gene Symbol: PPARA
  Gene Name: peroxisome proliferator-activated receptor alpha
  Uniprot ID: Q07869
  ENSP ID: ENSP00000262735
MVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPPFVIHDMETLCMAEKTLVAKLVANGIQNKEAEVRIFHCCQCTSVETVTELTEFAKAIPGFANLDLNDQVTLLKYGVYEAIFAMLSSVMNKDGMLVAYGNGFITREFLKSLRKPFCDIMEPKFDFAMKFNALELDDSDISLFVAAIICCGDRPGLLNVGHIEKMQEGIVHVLRLHLQSNHPDDIFLFPKLLQKMADLRQLVTEHAQLVQIIKKTESDAALHPLLQEIYRDMY

SEQ ID NO: 62137 - protein, 468 aa, Homo sapiens; identical to SEQ ID NO: 62136
  Payload ID: 12426
  Gene Symbol: PPARA
  Gene Name: peroxisome proliferator-activated receptor alpha
  Uniprot ID: Q07869
  ENSP ID: ENSP00000385246

SEQ ID NO: 62138 - protein, 468 aa, Homo sapiens; identical to SEQ ID NO: 62136
  Payload ID: 12426
  Gene Symbol: PPARA
  Gene Name: peroxisome proliferator-activated receptor alpha
  Uniprot ID: Q07869
  ENSP ID: ENSP00000385523

SEQ ID NO: 62139 - protein, 9 aa, Homo sapiens
  Payload ID: 12426
  Gene Symbol: PPARA
  Gene Name: peroxisome proliferator-activated receptor alpha
  ENSP ID: ENSP00000397291
MVDTESPLC

SEQ ID NO: 62140 - protein, 69 aa, Homo sapiens
  Payload ID: 12426
  Gene Symbol: PPARA
  Gene Name: peroxisome proliferator-activated receptor alpha
  ENSP ID: ENSP00000411677
MVDTESPLCPLSPLEAGDLESPLSEEFLQEMGNIQEISQSIGEDSSGSFGFTEYQYLGSCPGSDGSVIT

SEQ ID NO: 62141 - protein, 133 aa, Homo sapiens
  Payload ID: 12426
  Gene Symbol: PPARA
  Gene Name: peroxisome proliferator-activated receptor alpha
  ENSP ID: ENSP00000414752
MVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKVEGSWNRAWW

SEQ ID NO: 62142 - protein, 441 aa, Homo sapiens
  Payload ID: 12427
  Gene Symbol: PPARD
  Gene Name: peroxisome proliferator-activated receptor delta
  Uniprot ID: Q03181
  ENSP ID: ENSP00000310928
MEQPQEEAPEVREEEEKEEVAEAEGAPELNGGPQHALPSSSYTDLSRSSSPPSLLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDMY

SEQ ID NO: 62143 - protein, 361 aa, Homo sapiens
  Payload ID: 12427
  Gene Symbol: PPARD
  Gene Name: peroxisome proliferator-activated receptor delta
  Uniprot ID: Q03181
  ENSP ID: ENSP00000337063
MEQPQEEAPEVREEEEKEEVAEAEGAPELNGGPQHALPSSSYTDLSRSSSPPSLLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGGE

SEQ ID NO: 62144 - protein, 441 aa, Homo sapiens; identical to SEQ ID NO: 62142
  Payload ID: 12427
  Gene Symbol: PPARD
  Gene Name: peroxisome proliferator-activated receptor delta
  Uniprot ID: Q03181
  ENSP ID: ENSP00000353916

SEQ ID NO: 62145 - protein, 343 aa, Homo sapiens
  Payload ID: 12427
  Gene Symbol: PPARD
  Gene Name: peroxisome proliferator-activated receptor delta
  Uniprot ID: Q03181
  ENSP ID: ENSP00000413314
MEQPQEEAPEVREEEEKEEVAEAEGAPELNGGPQHALPSSSYTAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDMY

SEQ ID NO: 62146 - protein, 402 aa, Homo sapiens
  Payload ID: 12427
  Gene Symbol: PPARD
  Gene Name: peroxisome proliferator-activated receptor delta
  Uniprot ID: Q03181
  ENSP ID: ENSP00000414372
MHQRDLSRSSSPPSLLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDMY

SEQ ID NO: 62147 - protein, 505 aa, Homo sapiens
  Payload ID: 12428
  Gene Symbol: PPARG
  Gene Name: peroxisome proliferator-activated receptor gamma
  Uniprot ID: P37231
  ENSP ID: ENSP00000287820
MGETLGDSPIDPESDSFTDTLSANISQEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 62148 - protein, 477 aa, Homo sapiens
  Payload ID: 12428
  Gene Symbol: PPARG
  Gene Name: peroxisome proliferator-activated receptor gamma
  Uniprot ID: P37231
  ENSP ID: ENSP00000312472
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 62149 - protein, 186 aa, Homo sapiens
  Payload ID: 12428
  Gene Symbol: PPARG
  Gene Name: peroxisome proliferator-activated receptor gamma
  Uniprot ID: P37231
  ENSP ID: ENSP00000380195
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNEELQKDSY

SEQ ID NO: 62150 - protein, 250 aa, Homo sapiens
  Payload ID: 12428
  Gene Symbol: PPARG
  Gene Name: peroxisome proliferator-activated receptor gamma
  ENSP ID: ENSP00000380196
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSTAQVC

SEQ ID NO: 62151 - protein, 477 aa, Homo sapiens; identical to SEQ ID NO: 62148
  Payload ID: 12428
  Gene Symbol: PPARG
  Gene Name: peroxisome proliferator-activated receptor gamma
  Uniprot ID: P37231
  ENSP ID: ENSP00000380205

SEQ ID NO: 62152 - protein, 477 aa, Homo sapiens; identical to SEQ ID NO: 62148
  Payload ID: 12428
  Gene Symbol: PPARG
  Gene Name: peroxisome proliferator-activated receptor gamma
  Uniprot ID: P37231
  ENSP ID: ENSP00000380207

SEQ ID NO: 62153 - protein, 477 aa, Homo sapiens; identical to SEQ ID NO: 62148
  Payload ID: 12428
  Gene Symbol: PPARG
  Gene Name: peroxisome proliferator-activated receptor gamma
  Uniprot ID: P37231
  ENSP ID: ENSP00000380210

SEQ ID NO: 62154 - protein, 40 aa, Homo sapiens
  Payload ID: 12428
  Gene Symbol: PPARG
  Gene Name: peroxisome proliferator-activated receptor gamma
  ENSP ID: ENSP00000380218
MGETLGDSPIDPESDSFTDTLSANISQVFQDDSCLWMSLS

SEQ ID NO: 62155 - protein, 483 aa, Homo sapiens
  Payload ID: 12428
  Gene Symbol: PPARG
  Gene Name: peroxisome proliferator-activated receptor gamma
  ENSP ID: ENSP00000380221
MKGFSEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 62156 - protein, 132 aa, Homo sapiens
  Payload ID: 12428
  Gene Symbol: PPARG
  Gene Name: peroxisome proliferator-activated receptor gamma
  ENSP ID: ENSP00000380224
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCK

SEQ ID NO: 62157 - protein, 99 aa, Homo sapiens
  Payload ID: 12428
  Gene Symbol: PPARG
  Gene Name: peroxisome proliferator-activated receptor gamma
  ENSP ID: ENSP00000392285
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPH

SEQ ID NO: 62158 - protein, 43 aa, Homo sapiens
  Payload ID: 12428
  Gene Symbol: PPARG
  Gene Name: peroxisome proliferator-activated receptor gamma
  ENSP ID: ENSP00000411931
MTMVDTEMPFWPTNFGISSVDLSVMEDHSHSFDIKPFTTVDFS

SEQ ID NO: 62159 - protein, 798 aa, Homo sapiens
  Payload ID: 12429
  Gene Symbol: PPARGC1A
  Gene Name: peroxisome proliferator-activated receptor gamma, coactivator 1 alpha
  Uniprot ID: Q9UBK2
  ENSP ID: ENSP00000264867
MAWDMCNQDSESVWSDIECAALVGEDQPLCPDLPELDLSELDVNDLDTDSFLGGLKWCSDQSEIISNQYNNEPSNIFEKIDEENEANLLAVLTETLDSLPVDEDGLPSFDALTDGDVTTDNEASPSSMPDGTPPPQEAEEPSLLKKLLLAPANTQLSYNECSGLSTQNHANHNHRIRTNPAIVKTENSWSNKAKSICQQQKPQRRPCSELLKYLTTNDDPPHTKPTENRNSSRDKCTSKKKSHTQSQSQHLQAKPTTLSLPLTPESPNDPKGSPFENKTIERTLSVELSGTAGLTPPTTPPHKANQDNPFRASPKLKSSCKTVVPPPSKKPRYSESSGTQGNNSTKKGPEQSELYAQLSKSSVLTGGHEERKTKRPSLRLFGDHDYCQSINSKTEILINISQELQDSRQLENKDVSSDWQGQICSSTDSDQCYLRETLEASKQVSPCSTRKQLQDQEIRAELNKHFGHPSQAVFDDEADKTGELRDSDFSNEQFSKLPMFINSGLAMDGLFDDSEDESDKLSYPWDGTQSYSLFNVSPSCSSFNSPCRDSVSPPKSLFSQRPQRMRSRSRSFSRHRSCSRSPYSRSRSRSPGSRSSSRSCYYYESSHYRHRTHRNSPLYVRSRSRSPYSRRPRYDSYEEYQHERLKREEYRREYEKRESERAKQRERQRQKAIEERRVIYVGKIRPDTTRTELRDRFEVFGEIEECTVNLRDDGDSYGFITYRYTCDAFAALENGYTLRRSNETDFELYFCGRKQFFKSNYADLDSNSDDFDPASTKSKYDSLDFDSLLKEAQRSLRR

SEQ ID NO: 62160 - protein, 301 aa, Homo sapiens
  Payload ID: 12429
  Gene Symbol: PPARGC1A
  Gene Name: peroxisome proliferator-activated receptor gamma, coactivator 1 alpha
  Uniprot ID: Q9UBK2
  ENSP ID: ENSP00000421632
MAWDMCNQDSESVWSDIECAALVGEDQPLCPDLPELDLSELDVNDLDTDSFLGGLKWCSDQSEIISNQYNNEPSNIFEKIDEENEANLLAVLTETLDSLPVDEDGLPSFDALTDGDVTTDNEASPSSMPDGTPPPQEAEEPSLLKKLLLAPANTQLSYNECSGLSTQNHANHNHRIRTNPAIVKTENSWSNKAKSICQQQKPQRRPCSELLKYLTTNDDPPHTKPTENRNSSRDKCTSKKKSHTQSQSQHLQAKPTTLSLPLTPESPNDPKGSPFENKTIERTLSVELSGTAGVKTNLISK

SEQ ID NO: 62161 - protein, 271 aa, Homo sapiens
  Payload ID: 12429
  Gene Symbol: PPARGC1A
  Gene Name: peroxisome proliferator-activated receptor gamma, coactivator 1 alpha
  Uniprot ID: Q9UBK2
  ENSP ID: ENSP00000423075
MAWDMCNQDSESVWSDIECAALVGEDQPLCPDLPELDLSELDVNDLDTDSFLGGLKWCSDQSEIISNQYNNEPSNIFEKIDEENEANLLAVLTETLDSLPVDEDGLPSFDALTDGDVTTDNEASPSSMPDGTPPPQEAEEPSLLKKLLLAPANTQLSYNECSGLSTQNHANHNHRIRTNPAIVKTENSWSNKAKSICQQQKPQRRPCSELLKYLTTNDDPPHTKPTENRNSSRDKCTSKKKSHTQSQSQHLQAKPTTLSLPLTPESPNLFL

SEQ ID NO: 62162 - protein, 99 aa, Homo sapiens
  Payload ID: 12429
  Gene Symbol: PPARGC1A
  Gene Name: peroxisome proliferator-activated receptor gamma, coactivator 1 alpha
  ENSP ID: ENSP00000424181
MAWDMCNQDSESVWSDIECAALVGEDQPLCPDLPELDLSELDVNDLDTDSFLGGLKWCSDQSEIISNQYNNEPSNIFEVRTSFGNINFSLSLAWARLTW

SEQ ID NO: 62163 - protein, 297 aa, Homo sapiens
  Payload ID: 12429
  Gene Symbol: PPARGC1A
  Gene Name: peroxisome proliferator-activated receptor gamma, coactivator 1 alpha
  ENSP ID: ENSP00000477921
MCNQDSESVWSDIECAALVGEDQPLCPDLPELDLSELDVNDLDTDSFLGGLKWCSDQSEIISNQYNNEPSNIFEKIDEENEANLLAVLTETLDSLPVDEDGLPSFDALTDGDVTTDNEASPSSMPDGTPPPQEAEEPSLLKKLLLAPANTQLSYNECSGLSTQNHANHNHRIRTNPAIVKTENSWSNKAKSICQQQKPQRRPCSELLKYLTTNDDPPHTKPTENRNSSRDKCTSKKKSHTQSQSQHLQAKPTTLSLPLTPESPNDPKGSPFENKTIERTLSVELSGTAGVKTNLISK

SEQ ID NO: 62164 - protein, 267 aa, Homo sapiens
  Payload ID: 12429
  Gene Symbol: PPARGC1A
  Gene Name: peroxisome proliferator-activated receptor gamma, coactivator 1 alpha
  ENSP ID: ENSP00000479729
MCNQDSESVWSDIECAALVGEDQPLCPDLPELDLSELDVNDLDTDSFLGGLKWCSDQSEIISNQYNNEPSNIFEKIDEENEANLLAVLTETLDSLPVDEDGLPSFDALTDGDVTTDNEASPSSMPDGTPPPQEAEEPSLLKKLLLAPANTQLSYNECSGLSTQNHANHNHRIRTNPAIVKTENSWSNKAKSICQQQKPQRRPCSELLKYLTTNDDPPHTKPTENRNSSRDKCTSKKKSHTQSQSQHLQAKPTTLSLPLTPESPNLFL

SEQ ID NO: 62165 - protein, 671 aa, Homo sapiens
  Payload ID: 12429
  Gene Symbol: PPARGC1A
  Gene Name: peroxisome proliferator-activated receptor gamma, coactivator 1 alpha
  Uniprot ID: Q9UBK2
  ENSP ID: ENSP00000481498
MPDGTPPPQEAEEPSLLKKLLLAPANTQLSYNECSGLSTQNHANHNHRIRTNPAIVKTENSWSNKAKSICQQQKPQRRPCSELLKYLTTNDDPPHTKPTENRNSSRDKCTSKKKSHTQSQSQHLQAKPTTLSLPLTPESPNDPKGSPFENKTIERTLSVELSGTAGLTPPTTPPHKANQDNPFRASPKLKSSCKTVVPPPSKKPRYSESSGTQGNNSTKKGPEQSELYAQLSKSSVLTGGHEERKTKRPSLRLFGDHDYCQSINSKTEILINISQELQDSRQLENKDVSSDWQGQICSSTDSDQCYLRETLEASKQVSPCSTRKQLQDQEIRAELNKHFGHPSQAVFDDEADKTGELRDSDFSNEQFSKLPMFINSGLAMDGLFDDSEDESDKLSYPWDGTQSYSLFNVSPSCSSFNSPCRDSVSPPKSLFSQRPQRMRSRSRSFSRHRSCSRSPYSRSRSRSPGSRSSSRSCYYYESSHYRHRTHRNSPLYVRSRSRSPYSRRPRYDSYEEYQHERLKREEYRREYEKRESERAKQRERQRQKAIEERRVIYVGKIRPDTTRTELRDRFEVFGEIEECTVNLRDDGDSYGFITYRYTCDAFAALENGYTLRRSNETDFELYFCGRKQFFKSNYADLDSNSDDFDPASTKSKYDSLDFDSLLKEAQRSLRR

SEQ ID NO: 62166 - protein, 1023 aa, Homo sapiens
  Payload ID: 12430
  Gene Symbol: PPARGC1B
  Gene Name: peroxisome proliferator-activated receptor gamma, coactivator 1 beta
  Uniprot ID: Q86YN6
  ENSP ID: ENSP00000312649
MAGNDCGALLDEELSSFFLNYLADTQGGGSGEEQLYADFPELDLSQLDASDFDSATCFGELQWCPENSETEPNQYSPDDSELFQIDSENEALLAELTKTLDDIPEDDVGLAAFPALDGGDALSCTSASPAPSSAPPSPAPEKPSAPAPEVDELSLLQKLLLATSYPTSSSDTQKEGTAWRQAGLRSKSQRPCVKADSTQDKKAPMMQSQSRSCTELHKHLTSAQCCLQDRGLQPPCLQSPRLPAKEDKEPGEDCPSPQPAPASPRDSLALGRADPGAPVSQEDMQAMVQLIRYMHTYCLPQRKLPPQTPEPLPKACSNPSQQVRSRPWSRHHSKASWAEFSILRELLAQDVLCDVSKPYRLATPVYASLTPRSRPRPPKDSQASPGRPSSVEEVRIAASPKSTGPRPSLRPLRLEVKREVRRPARLQQQEEEDEEEEEEEEEEEKEEEEEWGRKRPGRGLPWTKLGRKLESSVCPVRRSRRLNPELGPWLTFADEPLVPSEPQGALPSLCLAPKAYDVERELGSPTDEDSGQDQQLLRGPQIPALESPCESGCGDMDEDPSCPQLPPRDSPRCLMLALSQSDPTFGKKSFEQTLTVELCGTAGLTPPTTPPYKPTEEDPFKPDIKHSLGKEIALSLPSPEGLSLKATPGAAHKLPKKHPERSELLSHLRHATAQPASQAGQKRPFSCSFGDHDYCQVLRPEGVLQRKVLRSWEPSGVHLEDWPQQGAPWAEAQAPGREEDRSCDAGAPPKDSTLLRDHEIRASLTKHFGLLETALEEEDLASCKSPEYDTVFEDSSSSSGESSFLPEEEEEEGEEEEEDDEEEDSGVSPTCSDHCPYQSPPSKANRQLCSRSRSSSGSSPCHSWSPATRRNFRCESRGPCSDRTPSIRHARKRREKAIGEGRVVYIQNLSSDMSSRELKRRFEVFGEIEECEVLTRNRRGEKYGFITYRCSEHAALSLTKGAALRKRNEPSFQLSYGGLRHFCWPRYTDYDSNSEEALPASGKSKYEAMDFDSLLKEAQQSLH

SEQ ID NO: 62167 - protein, 984 aa, Homo sapiens
  Payload ID: 12430
  Gene Symbol: PPARGC1B
  Gene Name: peroxisome proliferator-activated receptor gamma, coactivator 1 beta
  Uniprot ID: Q86YN6
  ENSP ID: ENSP00000353638
MAGNDCGALLDEELSSFFLNYLADTQGGGSGEEQLYADFPELDLSQLDASDFDSATCFGELQWCPENSETEPNQYSPDDSELFQIDSENEALLAELTKTLDDIPEDDVGLAAFPALDGGDALSCTSASPAPSSAPPSPAPEKPSAPAPEVDELSLADSTQDKKAPMMQSQSRSCTELHKHLTSAQCCLQDRGLQPPCLQSPRLPAKEDKEPGEDCPSPQPAPASPRDSLALGRADPGAPVSQEDMQAMVQLIRYMHTYCLPQRKLPPQTPEPLPKACSNPSQQVRSRPWSRHHSKASWAEFSILRELLAQDVLCDVSKPYRLATPVYASLTPRSRPRPPKDSQASPGRPSSVEEVRIAASPKSTGPRPSLRPLRLEVKREVRRPARLQQQEEEDEEEEEEEEEEEKEEEEEWGRKRPGRGLPWTKLGRKLESSVCPVRRSRRLNPELGPWLTFADEPLVPSEPQGALPSLCLAPKAYDVERELGSPTDEDSGQDQQLLRGPQIPALESPCESGCGDMDEDPSCPQLPPRDSPRCLMLALSQSDPTFGKKSFEQTLTVELCGTAGLTPPTTPPYKPTEEDPFKPDIKHSLGKEIALSLPSPEGLSLKATPGAAHKLPKKHPERSELLSHLRHATAQPASQAGQKRPFSCSFGDHDYCQVLRPEGVLQRKVLRSWEPSGVHLEDWPQQGAPWAEAQAPGREEDRSCDAGAPPKDSTLLRDHEIRASLTKHFGLLETALEEEDLASCKSPEYDTVFEDSSSSSGESSFLPEEEEEEGEEEEEDDEEEDSGVSPTCSDHCPYQSPPSKANRQLCSRSRSSSGSSPCHSWSPATRRNFRCESRGPCSDRTPSIRHARKRREKAIGEGRVVYIQNLSSDMSSRELKRRFEVFGEIEECEVLTRNRRGEKYGFITYRCSEHAALSLTKGAALRKRNEPSFQLSYGGLRHFCWPRYTDYDSNSEEALPASGKSKYEAMDFDSLLKEAQQSLH

SEQ ID NO: 62168 - protein, 1017 aa, Homo sapiens
  Payload ID: 12430
  Gene Symbol: PPARGC1B
  Gene Name: peroxisome proliferator-activated receptor gamma, coactivator 1 beta
  Uniprot ID: Q86YN6
  ENSP ID: ENSP00000377855
MAGNDCGALLDEELSSFFLNYLADTQGGGSGEEQLYADFPELDLSQLDASDFDSATCFGELQWCPENSETEPNQYSPDDSELFQIDSENEALLAELTKTLDDIPEDDVGLAAFPALDGGDALSCTSASPAPSSAPPSPAPEKPSAPAPEVDELSLLQKLLLATSYPTSSSDTQKEGTAWRQAGLRSKSQRPCVKADSTQDKKAPMMQSQSRSCTELHKHLTSAQCCLQDRGLQPPCLQSPRLPAKEDKEPGEDCPSPQPAPASPRDSLALGRADPGAPVSQEDMQAMVQLIRYMHTYCLPQRKLPPQTPEPLPKACSNPSQQVRSRPWSRHHSKASWAEFSILRELLAQDVLCDVSKPYRLATPVYASLTPRSRPRPPKDSQASPGRPSSVEEVRIAASPKSTGPRPSLRPLRLEVKREVRRPARLQQQEEEDEEEEEEEEEEEKEEEEEWGRKRPGRGLPWTKLGRKLESSVCPVRRSRRLNPELGPWLTFADEPLVPSEPQGALPSLCLAPKAYDVERELGSPTDEDSGQDQQLLRGPQIPALESPCESGCGDMDEDPSCPQLPPRDSPRCLMLALSQSDPTFGKKSFEQTLTVELCGTAGLTPPTTPPYKPTEEDPFKPDIKHSLGKEIALSLPSPEGLSLKATPGAAHKLPKKHPERSELLSHLRHATAQPASQAGQKRPFSCSFGDHDYCQVLRPEGVLQRKVLRSWEPSGVHLEDWPQQGAPWAEAQAPGREEDRSCDAGAPPKDSTLLRDHEIRASLTKHFGLLETALEEEDLASCKSPEYDTVFEDSSSSSGESSFLPEEEEEEGEEEEEDDEEEDSGVSPTCSDHCPYQSPPSKANRQLCSRSRSSSGSSPCHSWSPATRRNFRCESRGPCSDRTPSIRHARKRREKAIGEGRVVYIQNLSSDMSSRELKRRFEVFGEIEECEVLTRNRRGEKYGFITYRCSEHAALSLTKGAALRKRNEPSFQLSYGGLRHFCWPRYTDYGKPLKPSHSLVRLKAWEAVPSLNKTQS

SEQ ID NO: 62169 - protein, 959 aa, Homo sapiens
  Payload ID: 12430
  Gene Symbol: PPARGC1B
  Gene Name: peroxisome proliferator-activated receptor gamma, coactivator 1 beta
  Uniprot ID: Q86YN6
  ENSP ID: ENSP00000384403
MGGGSGEEQLYADFPELDLSQLDASDFDSATCFGELQWCPENSETEPNQYSPDDSELFQIDSENEALLAELTKTLDDIPEDDVGLAAFPALDGGDALSCTSASPAPSSAPPSPAPEKPSAPAPEVDELSLADSTQDKKAPMMQSQSRSCTELHKHLTSAQCCLQDRGLQPPCLQSPRLPAKEDKEPGEDCPSPQPAPASPRDSLALGRADPGAPVSQEDMQAMVQLIRYMHTYCLPQRKLPPQTPEPLPKACSNPSQQVRSRPWSRHHSKASWAEFSILRELLAQDVLCDVSKPYRLATPVYASLTPRSRPRPPKDSQASPGRPSSVEEVRIAASPKSTGPRPSLRPLRLEVKREVRRPARLQQQEEEDEEEEEEEEEEEKEEEEEWGRKRPGRGLPWTKLGRKLESSVCPVRRSRRLNPELGPWLTFADEPLVPSEPQGALPSLCLAPKAYDVERELGSPTDEDSGQDQQLLRGPQIPALESPCESGCGDMDEDPSCPQLPPRDSPRCLMLALSQSDPTFGKKSFEQTLTVELCGTAGLTPPTTPPYKPTEEDPFKPDIKHSLGKEIALSLPSPEGLSLKATPGAAHKLPKKHPERSELLSHLRHATAQPASQAGQKRPFSCSFGDHDYCQVLRPEGVLQRKVLRSWEPSGVHLEDWPQQGAPWAEAQAPGREEDRSCDAGAPPKDSTLLRDHEIRASLTKHFGLLETALEEEDLASCKSPEYDTVFEDSSSSSGESSFLPEEEEEEGEEEEEDDEEEDSGVSPTCSDHCPYQSPPSKANRQLCSRSRSSSGSSPCHSWSPATRRNFRCESRGPCSDRTPSIRHARKRREKAIGEGRVVYIQNLSSDMSSRELKRRFEVFGEIEECEVLTRNRRGEKYGFITYRCSEHAALSLTKGAALRKRNEPSFQLSYGGLRHFCWPRYTDYDSNSEEALPASGKSKYEAMDFDSLLKEAQQSLH

SEQ ID NO: 62170 - protein, 748 aa, Homo sapiens
  Payload ID: 12430
  Gene Symbol: PPARGC1B
  Gene Name: peroxisome proliferator-activated receptor gamma, coactivator 1 beta
  ENSP ID: ENSP00000409364
  MOD_RES (1)..(1): Any amino acid
XACSNPSQQVRSRPWSRHHSKASWAEFSILRELLAQDVLCDVSKPYRLATPVYASLTPRSRPRPPKDSQASPGRPSSVEEVRIAASPKSTGPRPSLRPLRLEVKREVRRPARLQQQEEEDEEEEEEEEEEEKEEEEEWGRKRPGRGLPWTKLGRKLESSVCPVRRSRRLNPELGPWLTFADEPLVPSEPQGALPSLCLAPKAYDVERELGSPTDEDSGQDQQLLRGPQIPALESPCESGCGDMDEDPSCPQLPPRDSPRCLMLALSQSDPTFGKKSFEQTLTVELCGTAGLTPPTTPPYKPTEEDPFKPDIKHSLGKEIALSLPSPEGLSLKATPGAAHKLPKKHPERSELLSHLRHATAQPASQAGQKRPFSCSFGDHDYCQVLRPEGVLQRKVLRSWEPSGVHLEDWPQQGAPWAEAQAPGREEDRSCDAGAPPKDSTLLRDHEIRASLTKHFGLLETALEEEDLASCKSPEYDTVFEDSSSSSGESSFLPEEEEEEGEEEEEDDEEEDSGVSPTCSDHCPYQSPPSKANRQLCSRSRSSSGSSPCHSWSPATRRNFRCESRGPCSDRTPSIRHARKRREKAIGEGRVVYIQNLSSDMSSRELKRRFEVFGEIEECEVLTRNRRGEKYGFITYRCSEHAALSLTKGAALRKRNEPSFQLSYGGLRHFCWPRYTDYGWQAVPTVQRSSQLPKALGCSHSTVPTHSGRFFNHPVFVSCSLPSPLPCLFTPMPRFQFRRGPSCVREKQV

SEQ ID NO: 62171 - protein, 1664 aa, Homo sapiens
  Payload ID: 12431
  Gene Symbol: PPRC1
  Gene Name: peroxisome proliferator-activated receptor gamma, coactivator-related 1
  Uniprot ID: Q5VV67
  ENSP ID: ENSP00000278070
MAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGGVDIPQEKRPLDRLQAPELANVAGLTPPATPPHQLWKPLAAVSLLAKAKSPKSTAQEGTLKPEGVTEAKHPAAVRLQEGVHGPSRVHVGSGDHDYCVRSRTPPKKMPALVIPEVGSRWNVKRHQDITIKPVLSLGPAAPPPPCIAASREPLDHRTSSEQADPSAPCLAPSSLLSPEASPCRNDMNTRTPPEPSAKQRSMRCYRKACRSASPSSQGWQGRRGRNSRSVSSGSNRTSEASSSSSSSSSSSRSRSRSLSPPHKRWRRSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDSNREDFDPAPVKSKFDSLDFDTLLKQAQKNLRR

SEQ ID NO: 62172 - protein, 631 aa, Homo sapiens
  Payload ID: 12431
  Gene Symbol: PPRC1
  Gene Name: peroxisome proliferator-activated receptor gamma, coactivator-related 1
  ENSP ID: ENSP00000359029
MAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGGVDIPQEKRPLDRLQAPELANVAGLTPPATPPHQLWKPLAAVSLLAKAKSPKSTAQEGTLKPEGVTEAKHPAAVRLQEGVHGPSRVHVGSGDHDYCVRSRTPPKKMPALVIPEVGSRWNVKRHQDITIKPVLSLGPAAPPPPCIAASREPLDHRTSSEQADPSAPCLAPSSLLSPEASPCRNDMNTRTPPEPSAKQRSMRCYRKACRSASPSSQGWQGRRGRNSRSVSSGSNRTSEASSSSSSSSSSSRSRSRSLSPPHKRWRRSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDSNREDFDPAPVKSKFDSLDFDTLLKQAQKNLRR

SEQ ID NO: 62173 - protein, 1400 aa, Homo sapiens
  Payload ID: 12431
  Gene Symbol: PPRC1
  Gene Name: peroxisome proliferator-activated receptor gamma, coactivator-related 1
  ENSP ID: ENSP00000399743
MAARRGRRDGVAPPPSGGPGPDPGGGARGSGWGSRSQAPYGTLGAVSGGEQVLLHEEAGDSGFVSLSRLGPSLRDKDLEMEELMLQDETLLGTMQSYMDASLISLIEDFGSLGESRLSLEDQNEVSLLTALTEILDNADSENLSPFDSIPDSELLVSPREGSSLHKLLTLSRTPPERDLITPVDPLGPSTGSSRGSGVEMSLPDPSWDFSPPSFLETSSPKLPSWRPPRSRPRWGQSPPPQQRSDGEEEEEVASFSGQILAGELDNCVSSIPDFPMHLACPEEEDKATAAEMAVPAAGDESISSLSELVRAMHPYCLPNLTHLASLEDELQEQPDDLTLPEGCVVLEIVGQAATAGDDLEIPVVVRQVSPGPRPVLLDDSLETSSALQLLMPTLESETEAAVPKVTLCSEKEGLSLNSEEKLDSACLLKPREVVEPVVPKEPQNPPANAAPGSQRARKGRKKKSKEQPAACVEGYARRLRSSSRGQSTVGTEVTSQVDNLQKQPQEELQKESGPLQGKGKPRAWARAWAAALENSSPKNLERSAGQSSPAKEGPLDLYPKLADTIQTNPIPTHLSLVDSAQASPMPVDSVEADPTAVGPVLAGPVPVDPGLVDLASTSSELVEPLPAEPVLINPVLADSAAVDPAVVPISDNLPPVDAVPSGPAPVDLALVDPVPNDLTPVDPVLVKSRPTDPRRGAVSSALGGSAPQLLVESESLDPPKTIIPEVKEVVDSLKIESGTSATTHEARPRPLSLSEYRRRRQQRQAETEERSPQPPTGKWPSLPETPTGLADIPCLVIPPAPAKKTALQRSPETPLEICLVPVGPSPASPSPEPPVSKPVASSPTEQVPSQEMPLLARPSPPVQSVSPAVPTPPSMSAALPFPAGGLGMPPSLPPPPLQPPSLPLSMGPVLPDPFTHYAPLPSWPCYPHVSPSGYPCLPPPPTVPLVSGTPGAYAVPPTCSVPWAPPPAPVSPYSSTCTYGPLGWGPGPQHAPFWSTVPPPPLPPASIGRAVPQPKMESRGTPAGPPENVLPLSMAPPLSLGLPGHGAPQTEPTKVEVKPVPASPHPKHKVSALVQSPQMKALACVSAEGVTVEEPASERLKPETQETRPREKPPLPATKAVPTPRQSTVPKLPAVHPARLRKLSFLPTPRTQGSEDVVQAFISEIGIEASDLSSLLEQFEKSEAKKECPPPAPADSLAVGNSGSSCSSSGRSRRCSSSSSSSSSSSSSSSSSSSSRSRSRSPSPRRRSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRQFCKRSYSDLDSNREDFDPAPVKSKFDSLDFDTLLKQAQKNLRR

SEQ ID NO: 62174 - protein, 193 aa, Homo sapiens
  Payload ID: 12432
  Gene Symbol: PERP
  Gene Name: PERP, TP53 apoptosis effector
  Uniprot ID: Q96FX8
  ENSP ID: ENSP00000397157
MIRCGLACERCRWILPLLLLSAIAFDIIALAGRGWLQSSDHGQTSSLWWKCSQEGGGSGSYEEGCQSLMEYAWGRAAAAMLFCGFIILVICFILSFFALCGPQMLVFLRVIGGLLALAAVFQIISLVIYPVKYTQTFTLHANPAVTYIYNWAYGFGWAATIILIGCAFFFCCLPNYEDDLLGNAKPRYFYTSA

SEQ ID NO: 62175 - protein, 156 aa, Homo sapiens
  Payload ID: 12433
  Gene Symbol: PSPN
  Gene Name: persephin
  Uniprot ID: O60542
  ENSP ID: ENSP00000245810
MAVGKFLLGSLLLLSLQLGQGWGPDARGVPVADGEFSSEQVAKAGGTWLGTHRPLARLRRALSGPCQLWSLTLSVAELGLGYASEEKVIFRYCAGSCPRGARTQHGLALARLQGQGRAHGGPCCRPTRYTDVAFLDDRHRWQRLPQLSAAACGCGG

SEQ ID NO: 62176 - protein, 164 aa, Homo sapiens
  Payload ID: 12433
  Gene Symbol: PSPN
  Gene Name: persephin
  ENSP ID: ENSP00000469884
MAVGKFLLGSLLLLSLQLGQGWGPDARGVPVADGEFSSEQVAKAGGTWLGKDFQGPSVTSQLSPALTLLTVSALPSHRHPPPPCPPAPSPVWSMPAVEPDPVRGRARPGLRLRGEGHLPLLRRQLPPWCPHPAWPGAGPAAGPGPSPRRALLPAHSLHRRGLPR

SEQ ID NO: 62177 - protein, 583 aa, Homo sapiens
  Payload ID: 12434
  Gene Symbol: PES1
  Gene Name: pescadillo ribosomal biogenesis factor 1
  Uniprot ID: O00541
  ENSP ID: ENSP00000334612
MGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 62178 - protein, 588 aa, Homo sapiens
  Payload ID: 12434
  Gene Symbol: PES1
  Gene Name: pescadillo ribosomal biogenesis factor 1
  Uniprot ID: O00541
  ENSP ID: ENSP00000346725
MGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEMSAQEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 62179 - protein, 571 aa, Homo sapiens
  Payload ID: 12434
  Gene Symbol: PES1
  Gene Name: pescadillo ribosomal biogenesis factor 1
  ENSP ID: ENSP00000384252
MGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEHPTDVDYRVMATFTEFYTTLLGFVNFRLYQLLNLHYPPKLEGQAQAEAKAGEGTYALDSESCMEKLAALSASLARVVVPATEEEAEVDEFPTDGEMSAQEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 62180 - protein, 449 aa, Homo sapiens
  Payload ID: 12434
  Gene Symbol: PES1
  Gene Name: pescadillo ribosomal biogenesis factor 1
  ENSP ID: ENSP00000384366
MCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEMSAQEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 62181 - protein, 135 aa, Homo sapiens
  Payload ID: 12434
  Gene Symbol: PES1
  Gene Name: pescadillo ribosomal biogenesis factor 1
  ENSP ID: ENSP00000384777
MCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCME

SEQ ID NO: 62182 - protein, 449 aa, Homo sapiens; identical to SEQ ID NO: 62180
  Payload ID: 12434
  Gene Symbol: PES1
  Gene Name: pescadillo ribosomal biogenesis factor 1
  ENSP ID: ENSP00000385654

SEQ ID NO: 62183 - protein, 194 aa, Homo sapiens
  Payload ID: 12434
  Gene Symbol: PES1
  Gene Name: pescadillo ribosomal biogenesis factor 1
  ENSP ID: ENSP00000404234
  MOD_RES (1)..(1): Any amino acid
XPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKPRVMAGTLKLEDKQRLAQEEESEAKRLAIMMMKKREKYLYQKIMFGKRRKIREANKLAEKRKAHDEAVRSEKKAKKARPE

SEQ ID NO: 62184 - protein, 178 aa, Homo sapiens
  Payload ID: 12435
  Gene Symbol: PCNP
  Gene Name: PEST proteolytic signal containing nuclear protein
  Uniprot ID: Q8WW12
  ENSP ID: ENSP00000265260
MADGKAGDEKPEKSQRAGAAGGPEEEAEKPVKTKTVSSSNGGESSSRSAEKRSAEEEAADLPTKPTKISKFGFAIGSQTTKKASAISIKLGSSKPKETVPTLAPKTLSVAAAFNEDEDSEPEEMPPEAKMRMKNIGRDTPTSAGPNSFNKGKHGFSDNQKLWERNIKSHLGNVHDQDN

SEQ ID NO: 62185 - protein, 40 aa, Homo sapiens
  Payload ID: 12435
  Gene Symbol: PCNP
  Gene Name: PEST proteolytic signal containing nuclear protein
  ENSP ID: ENSP00000418713
MADGKAGDEKPEKSQRAGAAGVNSWEPLLLPHNLSSCCIL

SEQ ID NO: 62186 - protein, 57 aa, Homo sapiens
  Payload ID: 12435
  Gene Symbol: PCNP
  Gene Name: PEST proteolytic signal containing nuclear protein
  ENSP ID: ENSP00000419390
MADGKAGDEKPEKSQRAGAAGVMEGKVPVAALRSDQLKKKLPTSQQSLQRSPSLDLP

SEQ ID NO: 62187 - protein, 55 aa, Homo sapiens
  Payload ID: 12435
  Gene Symbol: PCNP
  Gene Name: PEST proteolytic signal containing nuclear protein
  Uniprot ID: Q8WW12
  ENSP ID: ENSP00000470810
MPPEAKMRMKNIGRDTPTSAGPNSFNKGKHGFSDNQKLWERNIKSHLGNVHDQDN

SEQ ID NO: 62188 - protein, 40 aa, Homo sapiens; identical to SEQ ID NO: 62185
  Payload ID: 12435
  Gene Symbol: PCNP
  Gene Name: PEST proteolytic signal containing nuclear protein
  ENSP ID: ENSP00000485946

SEQ ID NO: 62189 - protein, 44 aa, Homo sapiens
  Payload ID: 12436
  Gene Symbol: PET100
  Gene Name: PET100 homolog
  ENSP ID: ENSP00000392303
MGVKLEIFRRELWPPEKLQEIEEFKERLRKRREEKLLRDAQQNS

SEQ ID NO: 62190 - protein, 46 aa, Homo sapiens
  Payload ID: 12436
  Gene Symbol: PET100
  Gene Name: PET100 homolog
  ENSP ID: ENSP00000470314
  MOD_RES (1)..(1): Any amino acid
XVKLEIFRMIIYLTFPVAMFWVSNQAEWFEDDVIQRKRELWPPEKP

SEQ ID NO: 62191 - protein, 73 aa, Homo sapiens
  Payload ID: 12436
  Gene Symbol: PET100
  Gene Name: PET100 homolog
  Uniprot ID: P0DJ07
  ENSP ID: ENSP00000470539
MGVKLEIFRMIIYLTFPVAMFWVSNQAEWFEDDVIQRKRELWPPEKLQEIEEFKERLRKRREEKLLRDAQQNS

SEQ ID NO: 62192 - protein, 68 aa, Homo sapiens
  Payload ID: 12436
  Gene Symbol: PET100
  Gene Name: PET100 homolog
  ENSP ID: ENSP00000470935
MGVKLEIFRMIIYLTFPVAMFWVSNQAEWFEDDVIQRKRELWPPEKVSDLFFLPEGWRRLDSCIRDGF

SEQ ID NO: 62193 - protein, 81 aa, Homo sapiens
  Payload ID: 12437
  Gene Symbol: PET117
  Gene Name: PET117 homolog
  Uniprot ID: Q6UWS5
  ENSP ID: ENSP00000397881
MSRSSKVVLGLSVLLTAATVAGVHVKQQWDQQRLRDGVIRDIERQIRKKENIRLLGEQIILTEQLEAEREKMLLAKGSQKS

SEQ ID NO: 62194 - protein, 473 aa, Homo sapiens
  Payload ID: 12438
  Gene Symbol: PPAN
  Gene Name: peter pan homolog (Drosophila)
  Uniprot ID: Q9NQ55
  ENSP ID: ENSP00000253107
MGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGRGRLCDQKFPKTKDKSQGAQARRGPRGASRDGGRGRGRGRPGKRVA

SEQ ID NO: 62195 - protein, 420 aa, Homo sapiens
  Payload ID: 12438
  Gene Symbol: PPAN
  Gene Name: peter pan homolog (Drosophila)
  ENSP ID: ENSP00000377382
MEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGRGRLCDQKFPKTKDKSQGAQARRGPRGASRDGGRGRGRGRPGKRVA

SEQ ID NO: 62196 - protein, 210 aa, Homo sapiens
  Payload ID: 12438
  Gene Symbol: PPAN
  Gene Name: peter pan homolog (Drosophila)
  ENSP ID: ENSP00000410485
MVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRL

SEQ ID NO: 62197 - protein, 208 aa, Homo sapiens
  Payload ID: 12438
  Gene Symbol: PPAN
  Gene Name: peter pan homolog (Drosophila)
  ENSP ID: ENSP00000415467
  MOD_RES (1)..(1): Any amino acid
XAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELDLFPEAKQKRLAKSPGRKRKRWEMDRGRGRLCDQKFPKTKDKSQGAQARRGPRGASRDGGRGRGRGRPGKRVA

SEQ ID NO: 62198 - protein, 97 aa, Homo sapiens
  Payload ID: 12438
  Gene Symbol: PPAN
  Gene Name: peter pan homolog (Drosophila)
  ENSP ID: ENSP00000415988
MVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATM

SEQ ID NO: 62199 - protein, 255 aa, Homo sapiens
  Payload ID: 12439
  Gene Symbol: PGAM5
  Gene Name: PGAM family member 5, serine/threonine protein phosphatase, mitochondrial
  Uniprot ID: Q96HS1
  ENSP ID: ENSP00000321503
MAFRQALQLAACGLAGGSAAVLFSAVAVGKPRAGGDAEPRPAEPPAWAGGARPGPGVWDPNWDRREPLSLINVRKRNVESGEEELASKLDHYKAKATRHIFLIRHSQYHVDGSLEKDRTLTPLGREQAELTGLRLASLGLKFNKIVHSSMTRAIETTDIISRHLPGVCKVSTDLLREGAPIEPDPPVSHWKPEAVQYYEDGARIEAAFRNYIHRADARQEEDSYEIFICHANVIRYIVCSIPPLLSAGDFVLLGS

SEQ ID NO: 62200 - protein, 140 aa, Homo sapiens
  Payload ID: 12439
  Gene Symbol: PGAM5
  Gene Name: PGAM family member 5, serine/threonine protein phosphatase, mitochondrial
  ENSP ID: ENSP00000409537
MTRAIETTDIISRHLPGVCKVSTDLLREGAPIEPDPPVSHWKPEAVQYYEDGARIEAAFRNYIHRADARQEEDSYEIFICHANVIRYIVCRALQFPPEGWLRLSLNNGSITHLVIRPNGRVALRTLGDTGFMPPDKITRS

SEQ ID NO: 62201 - protein, 289 aa, Homo sapiens
  Payload ID: 12439
  Gene Symbol: PGAM5
  Gene Name: PGAM family member 5, serine/threonine protein phosphatase, mitochondrial
  Uniprot ID: Q96HS1
  ENSP ID: ENSP00000438465
MAFRQALQLAACGLAGGSAAVLFSAVAVGKPRAGGDAEPRPAEPPAWAGGARPGPGVWDPNWDRREPLSLINVRKRNVESGEEELASKLDHYKAKATRHIFLIRHSQYHVDGSLEKDRTLTPLGREQAELTGLRLASLGLKFNKIVHSSMTRAIETTDIISRHLPGVCKVSTDLLREGAPIEPDPPVSHWKPEAVQYYEDGARIEAAFRNYIHRADARQEEDSYEIFICHANVIRYIVCRALQFPPEGWLRLSLNNGSITHLVIRPNGRVALRTLGDTGFMPPDKITRS

SEQ ID NO: 62202 - protein, 140 aa, Homo sapiens; identical to SEQ ID NO: 62200
  Payload ID: 12439
  Gene Symbol: PGAM5
  Gene Name: PGAM family member 5, serine/threonine protein phosphatase, mitochondrial
  ENSP ID: ENSP00000440372

SEQ ID NO: 62203 - protein, 1717 aa, Homo sapiens
  Payload ID: 12440
  Gene Symbol: PHLPP1
  Gene Name: PH domain and leucine rich repeat protein phosphatase 1
  Uniprot ID: O60346
  ENSP ID: ENSP00000262719
MEPAAAATVQRLPELGREDRASAPAAAAAAAAAAAAAAAALAAAAGGGRSPEPALTPAAPSGGNGSGSGAREEAPGEAPPGPLPGRAGGAGRRRRRGAPQPIAGGAAPVPGAGGGANSLLLRRGRLKRNLSAAAAAASSSSSSSAAAASHSPGAAGLPASCSASASLCTRSLDRKTLLLKHRQTLQLQPSDRDWVRHQLQRGCVHVFDRHMASTYLRPVLCTLDTTAGEVAARLLQLGHKGGGVVKVLGQGPGAAAAREPAEPPPEAGPRLAPPEPRDSEVPPARSAPGAFGGPPRAPPADLPLPVGGPGGWSRRASPAPSDSSPGEPFVGGPVSSPRAPRPVVSDTESFSLSPSAESVSDRLDPYSSGGGSSSSSEELEADAASAPTGVPGQPRRPGHPAQPLPLPQTASSPQPQQKAPRAIDSPGGAVREGSCEEKAAAAVAPGGLQSTPGRSGVTAEKAPPPPPPPTLYVQLHGETTRRLEAEEKPLQIQNDYLFQLGFGELWRVQEEGMDSEIGCLIRFYAGKPHSTGSSERIQLSGMYNVRKGKMQLPVNRWTRRQVILCGTCLIVSSVKDSLTGKMHVLPLIGGKVEEVKKHQHCLAFSSSGPQSQTYYICFDTFTEYLRWLRQVSKVASQRISSVDLSCCSLEHLPANLFYSQDLTHLNLKQNFLRQNPSLPAARGLNELQRFTKLKSLNLSNNHLGDFPLAVCSIPTLAELNVSCNALRSVPAAVGVMHNLQTFLLDGNFLQSLPAELENMKQLSYLGLSFNEFTDIPEVLEKLTAVDKLCMSGNCVETLRLQALRKMPHIKHVDLRLNVIRKLIADEVDFLQHVTQLDLRDNKLGDLDAMIFNNIEVLHCERNQLVTLDICGYFLKALYASSNELVQLDVYPVPNYLSYMDVSRNRLENVPEWVCESRKLEVLDIGHNQICELPARLFCNSSLRKLLAGHNQLARLPERLERTSVEVLDVQHNQLLELPPNLLMKADSLRFLNASANKLESLPPATLSEETNSILQELYLTNNSLTDKCVPLLTGHPHLKILHMAYNRLQSFPASKMAKLEELEEIDLSGNKLKAIPTTIMNCRRMHTVIAHSNCIEVFPEVMQLPEIKCVDLSCNELSEVTLPENLPPKLQELDLTGNPRLVLDHKTLELLNNIRCFKIDQPSTGDASGAPAVWSHGYTEASGVKNKLCVAALSVNNFCDNREALYGVFDGDRNVEVPYLLQCTMSDILAEELQKTKNEEEYMVNTFIVMQRKLGTAGQKLGGAAVLCHIKHDPVDPGGSFTLTSANVGKCQTVLCRNGKPLPLSRSYIMSCEEELKRIKQHKAIITEDGKVNGVTESTRILGYTFLHPSVVPRPHVQSVLLTPQDEFFILGSKGLWDSLSVEEAVEAVRNVPDALAAAKKLCTLAQSYGCHDSISAVVVQLSVTEDSFCCCELSAGGAVPPPSPGIFPPSVNMVIKDRPSDGLGVPSSSSGMASEISSELSTSEMSSEVGSTASDEPPPGALSENSPAYPSEQRCMLHPICLSNSFQRQLSSATFSSAFSDNGLDSDDEEPIEGVFTNGSRVEVEVDIHCSRAKEKEKQQHLLQVPAEASDEGIVISANEDEPGLPRKADFSAVGTIGRRRANGSVAPQERSHNVIEVATDAPLRKPGGYFAAPAQPDPDDQFIIPPELEEEVKEIMKHHQEQQQQQQPPPPPQLQPQLPRHYQLDQLPDYYDTPL

SEQ ID NO: 62204 - protein, 197 aa, Homo sapiens
  Payload ID: 12440
  Gene Symbol: PHLPP1
  Gene Name: PH domain and leucine rich repeat protein phosphatase 1
  ENSP ID: ENSP00000467279
  MOD_RES (1)..(1): Any amino acid
XYASSNELVQLDVYPVPNYLSYMDVSRNRLENVPEWVCESRKLEVLDIGHNQICELPARLFCNSSLRKLLAGHNQLARLPERLERTSVEVLDVQHNQLLELPPNLLMKADSKMAKLEELEEIDLSGNKLKAIPTTIMNCRRMHTVIAHSNCIEVFPEVMQLPEIKCVDLSCNELSEVTLPENLPPKLQELDLTGNPR

SEQ ID NO: 62205 - protein, 1256 aa, Homo sapiens
  Payload ID: 12441
  Gene Symbol: PHLPP2
  Gene Name: PH domain and leucine rich repeat protein phosphatase 2
  Uniprot ID: Q6ZVD8
  ENSP ID: ENSP00000377159
MKRNGSRNCLNRRSRFGSRERDWLREDVKRGCVYLYGADTTTATTTTTTSSSSSSSSSSSDLHLVLCTVETPASEICAGEGRESLYLQLHGDLVRRLEPTERPLQIVYDYLSRLGFDDPVRIQEEATNPDLGCMIRFYGEKPCHMDRLDRILLSGIYNVRKGKTQLHKWAERLVVLCGTCLIVSSVKDCQTGKMHILPLVGGKIEEVKRRQYSLAFSSAGAQAQTYHVSFETLAEYQRWQRQASKVVSQRISTVDLSCYSLEEVPEHLFYSQDITYLNLRHNFMQLERPGGLDTLYKFSQLKGLNLSHNKLGLFPILLCEISTLTELNLSCNGFHDLPSQIGNLLNLQTLCLDGNFLTTLPEELGNLQQLSSLGISFNNFSQIPEVYEKLTMLDRVVMAGNCLEVLNLGVLNRMNHIKHVDLRMNHLKTMVIENLEGNKHITHVDLRDNRLTDLDLSSLCSLEQLHCGRNQLRELTLSGFSLRTLYASSNRLTAVNVYPVPSLLTFLDLSRNLLECVPDWACEAKKIEVLDVSYNLLTEVPVRILSSLSLRKLMLGHNHVQNLPTLVEHIPLEVLDLQHNALTRLPDTLFSKALNKLNKLEQLEELNLSGNKLKTIPTTIANCKRLHTLVAHSNNISIFPEILQLPQIQFVDLSCNDLTEILIPEALPATLQDLDLTGNTNLVLEHKTLDIFSHITTLKIDQKPLPTTDSTVTSTFWSHGLAEMAGQRNKLCVSALAMDSFAEGVGAVYGMFDGDRNEELPRLLQCTMADVLLEEVQQSTNDTVFMANTFLVSHRKLGMAGQKLGSSALLCYIRPDTADPASSFSLTVANVGTCQAVLCRGGKPVPLSKVFSLEQDPEEAQRVKDQKAIITEDNKVNGVTCCTRMLGCTYLYPWILPKPHISSTPLTIQDELLILGNKALWEHLSYTEAVNAVRHVQDPLAAAKKLCTLAQSYGCQDNVGAMVVYLNIGEEGCTCEMNGLTLPGPVGFASTTTIKDAPKPATPSSSSGIASEFSSEMSTSEVSSEVGSTASDEHNAGGLDTALLPRPERRCSLHPTPTSGLFQRQPSSATFSSNQSDNGLDSDDDQPVEGVITNGSKVEVEVDIHCCRGRDLENSPPLIESSPTLCSEEHARGSCFGIRRQNSVNSGMLLPMSKDRMELQKSPSTSCLYGKKLSNGSIVPLEDSLNLIEVATEVPKRKTGYFAAPTQMEPEDQFVVPHDLEEEVKEQMKQHQDSRLEPEPHEEDRTEPPEEFDTAL

SEQ ID NO: 62206 - protein, 1358 aa, Homo sapiens
  Payload ID: 12441
  Gene Symbol: PHLPP2
  Gene Name: PH domain and leucine rich repeat protein phosphatase 2
  ENSP ID: ENSP00000454519
MGEVEPGPAGPLEPPEPPEAPASRRPGGIRVLKRNMKRNGSRNCLNRRSRFGSRERDWLREDVKRGCVYLYGADTTTATTTTTTSSSSSSSSSSSDLHLVLCTVETPASEICAGEGRESLYLQLHGDLVRRLEPTERPLQIVYDYLSRLGFDDPVRIQEEATNPDLGCMIRFYGEKPCHMDRLDRILLSGIYNVRKGKTQLHKWAERLVVLCGTCLIVSSVKDCQTGKMHILPLVGGKIEEVKRRQYSLAFSSAGAQAQTYHVSFETLAEYQRWQRQASKVVSQRISTVDLSCYSLEEVPEHLFYSQDITYLNLRHNFMQLERPGGLDTLYKFSQLKGLNLSHNKLGLFPILLCEISTLTELNLSCNGFHDLPSQIGNLLNLQTLCLDGNFLTTLPEELGNLQQLSSLGISFNNFSQIPEVYEKLTMLDRVVMAGNCLEVLNLGVLNRMNHIKHVDLRMNHLKTMVIENLEGNKHITHVDLRDNRLTDLDLSSLCSLEQLHCGRNQLRELTLSGFSLRTLYASSNRLTAVNVYPVPSLLTFLDLSRNLLECVPDWACEAKKIEVLDVSYNLLTEVPVRILSSLSLRKLMLGHNHVQNLPTLVEHIPLEVLDLQHNALTRLPDTLFSKALNLRYLNASANSLESLPSACTGEESLSMLQLLYLTNNLLTDQCIPVLVGHLHLRILHLANNQLQTFPASKLNKLEQLEELNLSGNKLKTIPTTIANCKRLHTLVAHSNNISIFPEILQLPQIQFVDLSCNDLTEILIPEALPATLQDLDLTGNTNLVLEHKTLDIFSHITTLKIDQKPLPTTDSTVTSTFWSHGLAEMAGQRNKLCVSALAMDSFAEGVGAVYGMFDGDRNEELPRLLQCTMADVLLEEVQQSTNDTVFMANTFLVSHRKLGMAGQKLGSSALLCYIRPDTADPASSFSLTVANVGTCQAVLCRGGKPVPLSKVFSLEQDPEEAQRVKDQKAIITEDNKVNGVTCCTRMLGCTYLYPWILPKPHISSTPLTIQDELLILGNKALWEHLSYTEAVNAVRHVQDPLAAAKKLCTLAQSYGCQDNVGAMVVYLNIGEEGCTCEMNGLTLPGPVGFASTTTIKDAPKPATPSSSSGIASEFSSEMSTSEVSSEVGSTASDEHNAGGLDTALLPRPERRCSLHPTPTSGLFQRQPSSATFSSNQSDNGLDSDDDQPVEGVITNGSKVEVEVDIHCCRGRDLENSPPLIESSPTLCSEEHARGSCFGIRRQNSVNSGMLLPMSKDRMELQKSPSTSCLYGKKLSNGSIVPLEDSLNLIEVATEVPKRKTGYFAAPTQMEPEDQFVVPHDLEEEVKEQMKQHQDSRLEPEPHEEDRTEPPEEFDTAL

SEQ ID NO: 62207 - protein, 319 aa, Homo sapiens
  Payload ID: 12441
  Gene Symbol: PHLPP2
  Gene Name: PH domain and leucine rich repeat protein phosphatase 2
  ENSP ID: ENSP00000456572
  MOD_RES (1)..(1): Any amino acid
XVLVGHLHLRILHLANNQLQTFPASKLNKLEQLEELNLSGNKLKTIPTTIANCKRLHTLVAHSNNISIFPEILQLPQIQFVDLSCNDLTEILIPEALPATLQDLDLTGNTNLVLEHKTLDIFSHITTLKIDQKPLPTTDSTVTSTFWSHGLAEMAGQRNKLCVSALAMDSFAEGVGAVYGMFDGDRNEELPRLLQCTMADVLLEEVQQSTNDTVFMANTFLVSHRKLGMAGQKLGSSALLCYIRPDTADPASSFSLTVANVGTCQAVLCRGGKPVPLSKVFSLEQDPEEAQRVKDQKAIITENWVLNQKHLQDFPGEDK

SEQ ID NO: 62208 - protein, 1323 aa, Homo sapiens
  Payload ID: 12441
  Gene Symbol: PHLPP2
  Gene Name: PH domain and leucine rich repeat protein phosphatase 2
  Uniprot ID: Q6ZVD8
  ENSP ID: ENSP00000457991
MKRNGSRNCLNRRSRFGSRERDWLREDVKRGCVYLYGADTTTATTTTTTSSSSSSSSSSSDLHLVLCTVETPASEICAGEGRESLYLQLHGDLVRRLEPTERPLQIVYDYLSRLGFDDPVRIQEEATNPDLGCMIRFYGEKPCHMDRLDRILLSGIYNVRKGKTQLHKWAERLVVLCGTCLIVSSVKDCQTGKMHILPLVGGKIEEVKRRQYSLAFSSAGAQAQTYHVSFETLAEYQRWQRQASKVVSQRISTVDLSCYSLEEVPEHLFYSQDITYLNLRHNFMQLERPGGLDTLYKFSQLKGLNLSHNKLGLFPILLCEISTLTELNLSCNGFHDLPSQIGNLLNLQTLCLDGNFLTTLPEELGNLQQLSSLGISFNNFSQIPEVYEKLTMLDRVVMAGNCLEVLNLGVLNRMNHIKHVDLRMNHLKTMVIENLEGNKHITHVDLRDNRLTDLDLSSLCSLEQLHCGRNQLRELTLSGFSLRTLYASSNRLTAVNVYPVPSLLTFLDLSRNLLECVPDWACEAKKIEVLDVSYNLLTEVPVRILSSLSLRKLMLGHNHVQNLPTLVEHIPLEVLDLQHNALTRLPDTLFSKALNLRYLNASANSLESLPSACTGEESLSMLQLLYLTNNLLTDQCIPVLVGHLHLRILHLANNQLQTFPASKLNKLEQLEELNLSGNKLKTIPTTIANCKRLHTLVAHSNNISIFPEILQLPQIQFVDLSCNDLTEILIPEALPATLQDLDLTGNTNLVLEHKTLDIFSHITTLKIDQKPLPTTDSTVTSTFWSHGLAEMAGQRNKLCVSALAMDSFAEGVGAVYGMFDGDRNEELPRLLQCTMADVLLEEVQQSTNDTVFMANTFLVSHRKLGMAGQKLGSSALLCYIRPDTADPASSFSLTVANVGTCQAVLCRGGKPVPLSKVFSLEQDPEEAQRVKDQKAIITEDNKVNGVTCCTRMLGCTYLYPWILPKPHISSTPLTIQDELLILGNKALWEHLSYTEAVNAVRHVQDPLAAAKKLCTLAQSYGCQDNVGAMVVYLNIGEEGCTCEMNGLTLPGPVGFASTTTIKDAPKPATPSSSSGIASEFSSEMSTSEVSSEVGSTASDEHNAGGLDTALLPRPERRCSLHPTPTSGLFQRQPSSATFSSNQSDNGLDSDDDQPVEGVITNGSKVEVEVDIHCCRGRDLENSPPLIESSPTLCSEEHARGSCFGIRRQNSVNSGMLLPMSKDRMELQKSPSTSCLYGKKLSNGSIVPLEDSLNLIEVATEVPKRKTGYFAAPTQMEPEDQFVVPHDLEEEVKEQMKQHQDSRLEPEPHEEDRTEPPEEFDTAL

SEQ ID NO: 62209 - protein, 723 aa, Homo sapiens
  Payload ID: 12441
  Gene Symbol: PHLPP2
  Gene Name: PH domain and leucine rich repeat protein phosphatase 2
  ENSP ID: ENSP00000458660
EVPEHLFYSQDITYLNLRHNFMQLERPGGLDTLYKFSQLKGLNLSHNKLGLFPILLCEISTLTELNLSCNGFHDLPSQIGNLLNLQTLCLDGNFLTTLPEELGNLQQLSSLGISFNNFSQIPEVYEKLTMLDRVVMAGNCLEVLNLGVLNRMNHIKHVDLRMNHLKTMVIENLEGNKHITHVDLRDNRLTDLDLSSLCSLEQLHCGRNQLRELTLSGFSLRTLYASSNRLTAVNVYPVPSLLTFLDLSRNLLECVPDWACEAKKIEVLDVSYNLLTEVPVRILSSLSLRKLMLGHNHVQNLPTLVEHIPLEVLDLQHNALTRLPDTLFSKALNLRYLNASANSLESLPSACTGEESLSMLQLLYLTNNLLTDQCIPVLVGHLHLRILHLANNQLQTFPASKLNKLEQLEELNLSGNKLKTIPTTIANCKRLHTLVAHSNNISIFPEILQLPQIQFVDLSCNDLTEILIPEALPATLQDLDLTGNTNLVLEHKTLDIFSHITTLKIDQKPLPTTDSTVTSTFWSHGLAEMAGQRNKLCVSALAMDSFAEGVGAVYGMFDGDRNEELPRLLQCTMADVLLEEVQQSTNDTVFMANTFLVSHRKLGMAGQKLGSSALLCYIRPDTADPASSFSLTVANVGTCQAVLCRGGKPVPLSKVFSLEQDPEEAQRVKDQKAIITEVPEDLKEFQTTDIPVHHCNFRAVLGCLCSASVLGSYAGPAPRWRRT

SEQ ID NO: 62210 - protein, 230 aa, Homo sapiens
  Payload ID: 12442
  Gene Symbol:
  Gene Name: PHACTR1
  ENSP ID: ENSP00000489003
NLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPVSEESPSASESGVLLSQDPSAKPVLLLPPKKPAAFPGDHEETPVKQLPLLKQPPALPPKPTTRIANHLTDWHQAHQVGQRHPLPPWQWAFSSPGSSKRIQSRPGAVAYACNPSTLGGRGRWIT

SEQ ID NO: 62211 - protein, 144 aa, Homo sapiens
  Payload ID: 12442
  Gene Symbol:
  Gene Name: PHACTR1
  ENSP ID: ENSP00000489049
MYLQGPRKLMTQGGYDMVQKLFLDFFRRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRFHRP

SEQ ID NO: 62212 - protein, 264 aa, Homo sapiens
  Payload ID: 12442
  Gene Symbol:
  Gene Name: PHACTR1
  ENSP ID: ENSP00000489276
  MOD_RES (1)..(1): Any amino acid
XSPFTPFSPLLSFFLSPFFFLFPSLSHSLPTPSLPLPSPFPSPSPVREPLPLPSSPFRLSPSPSVSFSLSARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPVSEESPS

SEQ ID NO: 62213 - protein, 484 aa, Homo sapiens
  Payload ID: 12442
  Gene Symbol:
  Gene Name: PHACTR1
  ENSP ID: ENSP00000489293
MDYPKMDYFLDVESAHRLLDVESAQRFFYSQGAQARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKRK

SEQ ID NO: 62214 - protein, 140 aa, Homo sapiens
  Payload ID: 12442
  Gene Symbol:
  Gene Name: PHACTR1
  ENSP ID: ENSP00000489306
MYLQGPRKLMTQGGYDMVQKLFLDFFRRRLSQRPTAEELEQRNILKPRNEQEEQEEKREIKRRLTRKLSQRPTVEELRERKILIRFSDYVEVADAQDYDRRADKPWTRLTAADKVSRGECWRVGGRTVCWVSLGSPLGSV

SEQ ID NO: 62215 - protein, 488 aa, Homo sapiens
  Payload ID: 12442
  Gene Symbol:
  Gene Name: PHACTR1
  ENSP ID: ENSP00000489396
MRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRFHRP

SEQ ID NO: 62216 - protein, 580 aa, Homo sapiens
  Payload ID: 12442
  Gene Symbol:
  Gene Name: PHACTR1
  ENSP ID: ENSP00000489436
MDYPKMDYFLDVESAHRLLDVESAQRFFYSQGAQARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRFHRP

SEQ ID NO: 62217 - protein, 169 aa, Homo sapiens
  Payload ID: 12442
  Gene Symbol:
  Gene Name: PHACTR1
  ENSP ID: ENSP00000489543
MDYPKMDYFLDVESAHRLLDVESAQRFFYSQGAQARRATLLLPPTLMAASSEDDIDRRPIRRVRSKSDTPYLAEARISFNLGAGVSLFGDMDEARMGPAVPTLGRPLGLELCSLENHGLLKTAPTYTTSAHICSGPSTGGQFSTQGMSPVQGAKRRRVVWLPLEGEEFG

SEQ ID NO: 62218 - protein, 1649 aa, Homo sapiens
  Payload ID: 12443
  Gene Symbol: PHRF1
  Gene Name: PHD and ring finger domains 1
  Uniprot ID: Q9P1Y6
  ENSP ID: ENSP00000264555
MDDDSLDELVARSPGPDGHPQVGPADPAGDFEESSVGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILRKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQVFSELPFPSHVLPEPGFPDTDPSQVYSPGLPPAPAQPSSIPPCALVSQPTVQFILQGSLPLVGCGAAQTLAPVPAALTPASEPASQATAASNSEEKTPAPRLAAEKTKKEEYMKKLHMQERAVEEVKLAIKPFYQKREVTKEEYKDILRKAVQKICHSKSGEINPVKVANLVKAYVDKYRHMRRHKKPEAGEEPPTQGAEG

SEQ ID NO: 62219 - protein, 1647 aa, Homo sapiens
  Payload ID: 12443
  Gene Symbol: PHRF1
  Gene Name: PHD and ring finger domains 1
  ENSP ID: ENSP00000388589
MDDDSLDELVARSPGPDGHPQVGPADPAGDFESSVGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILRKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQVFSELPFPSHVLPEPGFPDTDPSQVYSPGLPPAPAQPSSIPPCALVSQPTVQFILQGSLPLVGCGAAQTLAPVPAALTPASEPASQATAASNSEEKTPAPRLAAEKTKKEEYMKKLHMQERAVEEVKLAIKPFYQKREVTKEEYKDILRKAVQKICHSKSGEINPVKVANLVKAYVDKYRHMRRHKKPEAGEEPPTQGAEG

SEQ ID NO: 62220 - protein, 1648 aa, Homo sapiens
  Payload ID: 12443
  Gene Symbol: PHRF1
  Gene Name: PHD and ring finger domains 1
  Uniprot ID: Q9P1Y6
  ENSP ID: ENSP00000410626
MDDDSLDELVARSPGPDGHPQVGPADPAGDFEESSVGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILRKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQVFSELPFPSHVLPEPGFPDTDPSQVYSPGLPPAPAQPSSIPPCALVSQPTVQFILQGSLPLVGCGAAQTLAPVPAALTPASEPASQATAASNSEEKTPAPRLAAEKTKKEEYMKKLHMQERAVEEVKLAIKPFYQKREVTKEEYKDILRKAVQKICHSKSGEINPVKVANLVKAYVDKYRHMRRHKKPEAGEEPPTQGAEG

SEQ ID NO: 62221 - protein, 1645 aa, Homo sapiens
  Payload ID: 12443
  Gene Symbol: PHRF1
  Gene Name: PHD and ring finger domains 1
  ENSP ID: ENSP00000431870
MDDDSLDELVARSPGPDGHPQVGPADPAESSVGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILRKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQVFSELPFPSHVLPEPGFPDTDPSQVYSPGLPPAPAQPSSIPPCALVSQPTVQFILQGSLPLVGCGAAQTLAPVPAALTPASEPASQATAASNSEEKTPAPRLAAEKTKKEEYMKKLHMQERAVEEVKLAIKPFYQKREVTKEEYKDILRKAVQKICHSKSGEINPVKVANLVKAYVDKYRHMRRHKKPEAGEEPPTQGAEG

SEQ ID NO: 62222 - protein, 1494 aa, Homo sapiens
  Payload ID: 12443
  Gene Symbol: PHRF1
  Gene Name: PHD and ring finger domains 1
  Uniprot ID: Q9P1Y6
  ENSP ID: ENSP00000435360
MDDDSLDELVARSPGPDGHPQVGPADPAGDFEESSVGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILRKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQVFSELPFPSHVLPEPGFPDTDPSQPQSQPVKPLQPATRRRRPRPPG

SEQ ID NO: 62223 - protein, 1649 aa, Homo sapiens
  Payload ID: 12443
  Gene Symbol: PHRF1
  Gene Name: PHD and ring finger domains 1
  Uniprot ID: Q9P1Y6
  ENSP ID: ENSP00000483129
MDDDSLDELVARSPGPDGHPQVGPADPAGDFEESSVGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILRKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQAFSELPFPSHVLPEPGFPDTDPSQVYSPGLPPAPAQPSSIPPCALVSQPTVQFILQGSLPLVGCGAAQTLAPVPAALTPASEPASQATAASNSEEKTPAPRLAAEKTKKEEYMKKLHMQERAVEEVKLAIKPFYQKREVTKEEYKDILRKAVQKICHSKSGEINPVKVANLVKAYVDKYRHMRRHKKPEAGEEPPTQGAEG

SEQ ID NO: 62224 - protein, 1645 aa, Homo sapiens
  Payload ID: 12443
  Gene Symbol: PHRF1
  Gene Name: PHD and ring finger domains 1
  ENSP ID: ENSP00000487848
MDDDSLDELVARSPGPDGHPQVGPADPAESSVGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILRKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQAFSELPFPSHVLPEPGFPDTDPSQVYSPGLPPAPAQPSSIPPCALVSQPTVQFILQGSLPLVGCGAAQTLAPVPAALTPASEPASQATAASNSEEKTPAPRLAAEKTKKEEYMKKLHMQERAVEEVKLAIKPFYQKREVTKEEYKDILRKAVQKICHSKSGEINPVKVANLVKAYVDKYRHMRRHKKPEAGEEPPTQGAEG

SEQ ID NO: 62225 - protein, 1648 aa, Homo sapiens
  Payload ID: 12443
  Gene Symbol: PHRF1
  Gene Name: PHD and ring finger domains 1
  ENSP ID: ENSP00000487908
MDDDSLDELVARSPGPDGHPQVGPADPAGDFEESSVGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILRKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQAFSELPFPSHVLPEPGFPDTDPSQVYSPGLPPAPAQPSSIPPCALVSQPTVQFILQGSLPLVGCGAAQTLAPVPAALTPASEPASQATAASNSEEKTPAPRLAAEKTKKEEYMKKLHMQERAVEEVKLAIKPFYQKREVTKEEYKDILRKAVQKICHSKSGEINPVKVANLVKAYVDKYRHMRRHKKPEAGEEPPTQGAEG

SEQ ID NO: 62226 - protein, 1494 aa, Homo sapiens
  Payload ID: 12443
  Gene Symbol: PHRF1
  Gene Name: PHD and ring finger domains 1
  ENSP ID: ENSP00000488293
MDDDSLDELVARSPGPDGHPQVGPADPAGDFEESSVGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILRKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQAFSELPFPSHVLPEPGFPDTDPSQPQSQPVKPLQPATRRRRPRPPG

SEQ ID NO: 62227 - protein, 1647 aa, Homo sapiens
  Payload ID: 12443
  Gene Symbol: PHRF1
  Gene Name: PHD and ring finger domains 1
  ENSP ID: ENSP00000488773
MDDDSLDELVARSPGPDGHPQVGPADPAGDFESSVGSSGDSGDDSDSEHGDGTDGEDEGASEEEDLEDRSGSEDSEDDGETLLEVAGTQGKLEAAGSFNSDDDAESCPICLNAFRDQAVGTPENCAHYFCLDCIVEWSKNANSCPVDRTLFKCICIRAQFGGKILRKIPVENTKASEEEEDPTFCEVCGRSDREDRLLLCDGCDAGYHMECLDPPLQEVPVDEWFCPECAAPGVVLAADAGPVSEEEVSLLLADVVPTTSRLRPRAGRTRAIARTRQSERVRATVNRNRISTARRVQHTPGRLGSSLLDEAIEAVATGLSTAVYQRPLTPRTPARRKRKTRRRKKVPGRKKTPSGPSAKSKSSATRSKKRQHRVKKRRGKKVKSEATTRSRIARTLGLRRPVHSSCIPSVLKPVEPSLGLLRADIGAASLSLFGDPYELDPFDSEELSANPLSPLSAKRRALSRSALQSHQPVARPVSVGLSRRRLPAAVPEPDLEEEPVPDLLGSILSGQSLLMLGSSDVIIHRDGSLSAKRAAPVSFQRNSGSLSRGEEGFKGCLQPRALPSGSPAQGPSGNRPQSTGLSCQGRSRTPARTAGAPVRLDLPAAPGAVQARNLSNGSVPGFRQSHSPWFNGTNKHTLPLASAASKISSRDSKPPCRSVVPGPPLKPAPRRTDISELPRIPKIRRDDGGGRRDAAPAHGQSIEIPSACISRLTGREGTGQPGRGTRAESEASSRVPREPGVHTGSSRPPAPSSHGSLAPLGPSRGKGVGSTFESFRINIPGNMAHSSQLSSPGFCNTFRPVDDKEQRKENPSPLFSIKKTKQLRSEVYDPSDPTGSDSSAPGSSPERSGPGLLPSEITRTISINSPKAQTVQAVRCVTSYTVESIFGTEPEPPLGPSSAMSKLRGAVAAEGASDTEREEPTESQGLAARLRRPSPPEPWDEEDGASCSTFFGSEERTVTCVTVVEPEAPPSPDVLQAATHRVVELRPPSRSRSTSSSRSRKKAKRKRVSREHGRTRSGTRSESRDRSSRSASPSVGEERPRRQRSKAKSRRSSSDRSSSRERAKRKKAKDKSREHRRGPWGHSRRTSRSRSGSPGSSSYEHYESRKKKKRRSASRPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQAFSELPFPSHVLPEPGFPDTDPSQVYSPGLPPAPAQPSSIPPCALVSQPTVQFILQGSLPLVGCGAAQTLAPVPAALTPASEPASQATAASNSEEKTPAPRLAAEKTKKEEYMKKLHMQERAVEEVKLAIKPFYQKREVTKEEYKDILRKAVQKICHSKSGEINPVKVANLVKAYVDKYRHMRRHKKPEAGEEPPTQGAEG

SEQ ID NO: 62228 - protein, 457 aa, Homo sapiens
  Payload ID: 12444
  Gene Symbol: PHF1
  Gene Name: PHD finger protein 1
  Uniprot ID: O43189
  ENSP ID: ENSP00000363636
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSRLLSALNSHKDRFISGREIKKRKCLFGLHARMPPPVEPPTGDGALTRAGPWGRGLTSPGEAPEAGARAPEEEAEGESGGAGATLSSAQSARAPGAEGAGSSAEGTAAAPSGCLLPSTLLPAPQGPLGTVDPQTGHPWNFTLVSPQTSLKVPPTR

SEQ ID NO: 62229 - protein, 567 aa, Homo sapiens
  Payload ID: 12444
  Gene Symbol: PHF1
  Gene Name: PHD finger protein 1
  Uniprot ID: O43189
  ENSP ID: ENSP00000363640
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSRLLSALNSHKDRFISGREIKKRKCLFGLHARMPPPVEPPTGDGALTSFPSGQGPGGGVSRPLGKRRRPEPEPLRRRQKGKVEELGPPSAVRNQPEPQEQRERAHLQRALQASVSPPSPSPNQSYQGSSGYNFRPTDARCLPSSPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPDGSVQYLVEWGGGGIF

SEQ ID NO: 62230 - protein, 567 aa, Homo sapiens
  Payload ID: 12444
  Gene Symbol: PHF1
  Gene Name: PHD finger protein 1
  Uniprot ID: O43189
  ENSP ID: ENSP00000391901
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSKLLSALNSHKDRFISGREIKKRKCLFGLHARMPPPVEPPTGDGALTSFPSGQGPGGGVSRPLGKRRRPEPEPLRRRQKGKVEELGPPSAVRNQPEPQEQRERAHLQRALQASVSPPSPSPNQSYQGSSGYNFRPTDARCLPSSPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPDGSVQYLVEWGGGGIF

SEQ ID NO: 62231 - protein, 227 aa, Homo sapiens
  Payload ID: 12444
  Gene Symbol: PHF1
  Gene Name: PHD finger protein 1
  ENSP ID: ENSP00000392697
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGD

SEQ ID NO: 62232 - protein, 145 aa, Homo sapiens
  Payload ID: 12444
  Gene Symbol: PHF1
  Gene Name: PHD finger protein 1
  ENSP ID: ENSP00000395839
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIAT

SEQ ID NO: 62233 - protein, 227 aa, Homo sapiens; identical to SEQ ID NO: 62231
  Payload ID: 12444
  Gene Symbol: PHF1
  Gene Name: PHD finger protein 1
  ENSP ID: ENSP00000396023

SEQ ID NO: 62234 - protein, 181 aa, Homo sapiens
  Payload ID: 12444
  Gene Symbol: PHF1
  Gene Name: PHD finger protein 1
  ENSP ID: ENSP00000399226
WGHPQQCAISPSPRSRGSGLICRGHCRPQCLHHPPALTRVTRAAAATTSGPQMPAACPGHPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPDGSVQYLVEWGGGGIF

SEQ ID NO: 62235 - protein, 37 aa, Homo sapiens
  Payload ID: 12444
  Gene Symbol: PHF1
  Gene Name: PHD finger protein 1
  ENSP ID: ENSP00000404788
  MOD_RES (1)..(1): Any amino acid
XGATLSSAQSARAPGAEGAGSSAEGTAGLSVSTIPQP

SEQ ID NO: 62236 - protein, 457 aa, Homo sapiens
  Payload ID: 12444
  Gene Symbol: PHF1
  Gene Name: PHD finger protein 1
  Uniprot ID: O43189
  ENSP ID: ENSP00000407295
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSKLLSALNSHKDRFISGREIKKRKCLFGLHARMPPPVEPPTGDGALTRAGPWGRGLTSPGEAPEAGARAPEEEAEGESGGAGATLSSAQSARAPGAEGAGSSAEGTAAAPSGCLLPSTLLPAPQGPLGTVDPQTGHPWNFTLVSPQTSLKVPPTR

SEQ ID NO: 62237 - protein, 145 aa, Homo sapiens; identical to SEQ ID NO: 62232
  Payload ID: 12444
  Gene Symbol: PHF1
  Gene Name: PHD finger protein 1
  ENSP ID: ENSP00000410494

SEQ ID NO: 62238 - protein, 243 aa, Homo sapiens
  Payload ID: 12444
  Gene Symbol: PHF1
  Gene Name: PHD finger protein 1
  ENSP ID: ENSP00000413510
  MOD_RES (1)..(1): Any amino acid
XSLLLTATRTVSFQGERLRRGNVCLVSMLGCLPLWSPLLEMEHSPGQGPGGGVSRPLGKRRRPEPEPLRRRQKGKVEELGPPSAVRNQPEPQEQRERAHLQRALQASVSPPSPSPNQSYQGSSGYNFRPTDARCLPSPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPD

SEQ ID NO: 62239 - protein, 393 aa, Homo sapiens
  Payload ID: 12444
  Gene Symbol: PHF1
  Gene Name: PHD finger protein 1
  ENSP ID: ENSP00000432419
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSRLLSALNSHKDRFISGREIKKRKCLFGLHARMPPPVEPPTGDGALTSFPSGQGPGGGVSRPLGKRRRPEPEPLRRRQKGKVEELGPPSAP

SEQ ID NO: 62240 - protein, 393 aa, Homo sapiens
  Payload ID: 12444
  Gene Symbol: PHF1
  Gene Name: PHD finger protein 1
  ENSP ID: ENSP00000433516
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSKLLSALNSHKDRFISGREIKKRKCLFGLHARMPPPVEPPTGDGALTSFPSGQGPGGGVSRPLGKRRRPEPEPLRRRQKGKVEELGPPSAP

SEQ ID NO: 62241 - protein, 419 aa, Homo sapiens
  Payload ID: 12444
  Gene Symbol: PHF1
  Gene Name: PHD finger protein 1
  ENSP ID: ENSP00000434347
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSRLLSALNSHKDRFISGREIKKRKCLFGLHARMPPPVEPPTGDGALTRAGPWGRGLTSPGEAPEAGARAPEEEAEGESGGAGATLSSAQSARAPGAEGAGSSAEGTAGLSVSTIPQP

SEQ ID NO: 62242 - protein, 54 aa, Homo sapiens
  Payload ID: 12444
  Gene Symbol: PHF1
  Gene Name: PHD finger protein 1
  ENSP ID: ENSP00000434774
MPAACPAAPSGCLLPSTLLPAPQGPLGTVDPQTGHPWNFTLVSPQTSLKVPPTR

SEQ ID NO: 62243 - protein, 54 aa, Homo sapiens
  Payload ID: 12444
  Gene Symbol: PHF1
  Gene Name: PHD finger protein 1
  ENSP ID: ENSP00000479423
MAQPPRLSRSGASSLWDPASPAPTSGPRPRLWEGQDVLARWTDGLLYLGTIKKC

SEQ ID NO: 62244 - protein, 498 aa, Homo sapiens
  Payload ID: 12445
  Gene Symbol: PHF10
  Gene Name: PHD finger protein 10
  Uniprot ID: Q8WUB8
  ENSP ID: ENSP00000341805
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 62245 - protein, 496 aa, Homo sapiens
  Payload ID: 12445
  Gene Symbol: PHF10
  Gene Name: PHD finger protein 10
  Uniprot ID: Q8WUB8
  ENSP ID: ENSP00000355743
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 62246 - protein, 377 aa, Homo sapiens
  Payload ID: 12445
  Gene Symbol: PHF10
  Gene Name: PHD finger protein 10
  ENSP ID: ENSP00000479515
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKVEEKSP

SEQ ID NO: 62247 - protein, 451 aa, Homo sapiens
  Payload ID: 12445
  Gene Symbol: PHF10
  Gene Name: PHD finger protein 10
  Uniprot ID: Q8WUB8
  ENSP ID: ENSP00000484117
MGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 62248 - protein, 292 aa, Homo sapiens
  Payload ID: 12446
  Gene Symbol: PHF11
  Gene Name: PHD finger protein 11
  Uniprot ID: Q9UIL8
  ENSP ID: ENSP00000350209
MEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEEHGRHTDATVKVPFLKKCKEAGLLNYLLEEILDKVHSIPEKLMDETTSESDYEEIGSALFDCRLFEDTFVNFQAAIEKKIHASQQRWQQLKEEIELLQDLKQTLCSFQENRDLMSSSTSISSLSY

SEQ ID NO: 62249 - protein, 331 aa, Homo sapiens
  Payload ID: 12446
  Gene Symbol: PHF11
  Gene Name: PHD finger protein 11
  Uniprot ID: Q9UIL8
  ENSP ID: ENSP00000367570
MAQASPPRPERVLGASSPEARPAQEALLLPTGVFQVAEKMEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEEHGRHTDATVKVPFLKKCKEAGLLNYLLEEILDKVHSIPEKLMDETTSESDYEEIGSALFDCRLFEDTFVNFQAAIEKKIHASQQRWQQLKEEIELLQDLKQTLCSFQENRDLMSSSTSISSLSY

SEQ ID NO: 62250 - protein, 286 aa, Homo sapiens
  Payload ID: 12446
  Gene Symbol: PHF11
  Gene Name: PHD finger protein 11
  ENSP ID: ENSP00000394883
  MOD_RES (1)..(1): Any amino acid
XRPGPRGCSAPAARRPGPRRRRSSFPPLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEEHGRHTDATVKVPFLKKCKEAGLLNYLLEEILDKVHSIPEKLMDETTSESDYEEIGSALFDCRLFEDTFVNFQAAIEKKIHASQQRWQQLKEEIELLQDLKQTLCSFQENRDLMSSSTSISSLSY

SEQ ID NO: 62251 - protein, 168 aa, Homo sapiens
  Payload ID: 12446
  Gene Symbol: PHF11
  Gene Name: PHD finger protein 11
  ENSP ID: ENSP00000405227
MEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEE

SEQ ID NO: 62252 - protein, 292 aa, Homo sapiens; identical to SEQ ID NO: 62248
  Payload ID: 12446
  Gene Symbol: PHF11
  Gene Name: PHD finger protein 11
  Uniprot ID: Q9UIL8
  ENSP ID: ENSP00000417539

SEQ ID NO: 62253 - protein, 226 aa, Homo sapiens
  Payload ID: 12446
  Gene Symbol: PHF11
  Gene Name: PHD finger protein 11
  ENSP ID: ENSP00000418630
MEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEEHGRHTDATVKVPFLKKCKEAGLLNYLLEEILDKVHSIPEKLMDETTSESDQALPKQCA

SEQ ID NO: 62254 - protein, 133 aa, Homo sapiens
  Payload ID: 12446
  Gene Symbol: PHF11
  Gene Name: PHD finger protein 11
  ENSP ID: ENSP00000419229
MDCKLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFI

SEQ ID NO: 62255 - protein, 98 aa, Homo sapiens
  Payload ID: 12446
  Gene Symbol: PHF11
  Gene Name: PHD finger protein 11
  ENSP ID: ENSP00000420129
MEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAK

SEQ ID NO: 62256 - protein, 190 aa, Homo sapiens
  Payload ID: 12446
  Gene Symbol: PHF11
  Gene Name: PHD finger protein 11
  ENSP ID: ENSP00000482432
MEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEEHGRHTDATVKVPFLKKCKERTS

SEQ ID NO: 62257 - protein, 159 aa, Homo sapiens
  Payload ID: 12446
  Gene Symbol: PHF11
  Gene Name: PHD finger protein 11
  ENSP ID: ENSP00000483500
MAQASPPRPERVLGASSPEARPAQEALLLPTGVFQVAEKMEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKYLIKHF

SEQ ID NO: 62258 - protein, 704 aa, Homo sapiens
  Payload ID: 12447
  Gene Symbol: PHF12
  Gene Name: PHD finger protein 12
  Uniprot ID: Q96QT6
  ENSP ID: ENSP00000268756
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSGECCSALG

SEQ ID NO: 62259 - protein, 1004 aa, Homo sapiens
  Payload ID: 12447
  Gene Symbol: PHF12
  Gene Name: PHD finger protein 12
  Uniprot ID: Q96QT6
  ENSP ID: ENSP00000329933
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIGTGADMDVCLTNYGHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 62260 - protein, 705 aa, Homo sapiens
  Payload ID: 12447
  Gene Symbol: PHF12
  Gene Name: PHD finger protein 12
  ENSP ID: ENSP00000368157
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSALGVPEPMG

SEQ ID NO: 62261 - protein, 129 aa, Homo sapiens
  Payload ID: 12447
  Gene Symbol: PHF12
  Gene Name: PHD finger protein 12
  ENSP ID: ENSP00000463900
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKVLARGEERRKPQGKMLRRHSMN

SEQ ID NO: 62262 - protein, 215 aa, Homo sapiens
  Payload ID: 12447
  Gene Symbol: PHF12
  Gene Name: PHD finger protein 12
  ENSP ID: ENSP00000465017
MPARLRAGGYSLTAAAREPGRRLSLRLRAASADPGAPARVALRALAQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVD

SEQ ID NO: 62263 - protein, 849 aa, Homo sapiens
  Payload ID: 12447
  Gene Symbol: PHF12
  Gene Name: PHD finger protein 12
  Uniprot ID: Q96QT6
  ENSP ID: ENSP00000465161
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEGAHVHTCHHIIRSPLYVCEWSPCLHGESELPVSQTSLCAFHGLNKAPWFFSEESRNKMATTAF

SEQ ID NO: 62264 - protein, 80 aa, Homo sapiens
  Payload ID: 12447
  Gene Symbol: PHF12
  Gene Name: PHD finger protein 12
  ENSP ID: ENSP00000465255
  MOD_RES (1)..(1): Any amino acid
XFDRFQDTVSQHVVKVDFLNRIHKKHPPNRRCRDTSAGFWRAPHRSAKKGGTGPSCVLPPLRVGRSCEHVLSNPLHRDRS

SEQ ID NO: 62265 - protein, 54 aa, Homo sapiens
  Payload ID: 12447
  Gene Symbol: PHF12
  Gene Name: PHD finger protein 12
  ENSP ID: ENSP00000465374
  MOD_RES (1)..(1): Any amino acid
XLPNELTCTTALPGSSKRRRKEETTGKNVKKTQHELDHNGLVPLPVKVCFTCNS

SEQ ID NO: 62266 - protein, 30 aa, Homo sapiens
  Payload ID: 12447
  Gene Symbol: PHF12
  Gene Name: PHD finger protein 12
  ENSP ID: ENSP00000466695
MLPPGEWMCHRCTVRRKKREQKKELGHVNG

SEQ ID NO: 62267 - protein, 92 aa, Homo sapiens
  Payload ID: 12447
  Gene Symbol: PHF12
  Gene Name: PHD finger protein 12
  ENSP ID: ENSP00000467091
MLPPGEWMCHRCTVRRKKREQKKELGHVNGLVDKSGKRTTSPSSDTDLLDRSASKTELKAIAHARILERRASRPGTPTSSASTETPTSEQND

SEQ ID NO: 62268 - protein, 273 aa, Homo sapiens
  Payload ID: 12447
  Gene Symbol: PHF12
  Gene Name: PHD finger protein 12
  ENSP ID: ENSP00000467363
PLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSANSTAMVDLTNSLRAFMDVNGEIEINMLDEKLIKFLALQRIHQLFPSRVQPSPGSVGTHQLASGGHHIE

SEQ ID NO: 62269 - protein, 117 aa, Homo sapiens
  Payload ID: 12447
  Gene Symbol: PHF12
  Gene Name: PHD finger protein 12
  ENSP ID: ENSP00000467921
MGGRRTKGGRGVGDGETAPGGRRTARELRVCTHAVCMCVQQIQALLAPPKTDEAEKRSRKPEKEPRRSGRATNHDSCDSCKEGGDLLCCDHCPAAFHLQCCNPPLSEEMLPPGEWMC

SEQ ID NO: 62270 - protein, 153 aa, Homo sapiens
  Payload ID: 12447
  Gene Symbol: PHF12
  Gene Name: PHD finger protein 12
  ENSP ID: ENSP00000468478
MLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKR

SEQ ID NO: 62271 - protein, 300 aa, Homo sapiens
  Payload ID: 12448
  Gene Symbol: PHF13
  Gene Name: PHD finger protein 13
  Uniprot ID: Q86YI8
  ENSP ID: ENSP00000366876
MDSDSCAAAFHPEEYSPSCKRRRTVEDFNKFCTFVLAYAGYIPYPKEELPLRSSPSPANSTAGTIDSDGWDAGFSDIASSVPLPVSDRCFSHLQPTLLQRAKPSNFLLDRKKTDKLKKKKKRKRRDSDAPGKEGYRGGLLKLEAADPYVETPTSPTLQDIPQAPSDPCSGWDSDTPSSGSCATVSPDQVKEIKTEGKRTIVRQGKQVVFRDEDSTGNDEDIMVDSDDDSWDLVTCFCMKPFAGRPMIECNECHTWIHLSCAKIRKSNVPEVFVCQKCRDSKFDIRRSNRSRTGSRKLFLD

SEQ ID NO: 62272 - protein, 888 aa, Homo sapiens
  Payload ID: 12449
  Gene Symbol: PHF14
  Gene Name: PHD finger protein 14
  Uniprot ID: O94880
  ENSP ID: ENSP00000385795
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKKEKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEGCYGVDGESDSIMSSASENSTEPWFCDACKCGVSPSCELCPNQDGIFKETDAGRWVHIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRYPS

SEQ ID NO: 62273 - protein, 42 aa, Homo sapiens
  Payload ID: 12449
  Gene Symbol: PHF14
  Gene Name: PHD finger protein 14
  ENSP ID: ENSP00000398407
MDRSSKRRQVKPLAASLLEALDYDSSDDSDFKVGDASGLADS

SEQ ID NO: 62274 - protein, 42 aa, Homo sapiens; identical to SEQ ID NO: 62273
  Payload ID: 12449
  Gene Symbol: PHF14
  Gene Name: PHD finger protein 14
  ENSP ID: ENSP00000428601

SEQ ID NO: 62275 - protein, 948 aa, Homo sapiens
  Payload ID: 12449
  Gene Symbol: PHF14
  Gene Name: PHD finger protein 14
  ENSP ID: ENSP00000489535
MDRSSKRRQVKPLAASLLEALDYDSSDDSDFKVGDASDSEGSGNGSEDASKDSGEGSCSDSEENILEEELNEDIKVKEEQLKNSAEEEVLSSEKQLIKMEKKEEEENGERPRKKKEKEKEKEKEKEKEKEREKEKEKATVSENVAASAAATTPATSPPAVNTSPSVPTTTTATEEQVSEPKKWNLRRNRPLLDFVSMEELNDMDDYDSEDDNDWRPTVVKRKGRSASQKEGSDGDNEDDEDEGSGSDEDENDEGNDEDHSSPASEGGCKKKKSKVLSRNSADDEELTNDSLTLSQSKSNEDSLILEKSQNWSSQKMDHILICCVCLGDNSEDADEIIQCDNCGITVHEGCYGVDGESDSIMSSASENSTEPWFCDACKCGVSPSCELCPNQDGIFKETDAGRWVHIVCALYVPGVAFGDIDKLRPVTLTEMNYSKYGAKECSFCEDPRFARTGVCISCDAGMCRAYFHVTCAQKEGLLSEAAAEEDIADPFFAYCKQHADRLDRKWKRKNYLALQSYCKMSLQEREKQLSPEAQARINARLQQYRAKAELARSTRPQAWVPREKLPRPLTSSASAIRKLMRKAELMGISTDIFPVDNSDTSSSVDGRRKHKQPALTADFVNYYFERNMRMIQIQENMAEQKNIKDKLENEQEKLHVEYNKLCESLEELQNLNGKLRSEGQGIWALLGRITGQKLNIPAILRAPKERKPSKKEGGTQKTSTLPAVLYSCGICKKNHDQHLLLLCDTCKLHYHLGCLDPPLTRMPRKTKNSYWQCSECDQAGSSDMEADMAMETLPDGTKRSRRQIKEPVKFVPQDVPPEPKKIPIRNTRTRGRKRSFVPEEEKHEERVPRERRQRQSVLQKKPKAEDLRTECATCKGTGDNENLVRCDECRLCYHFGCLDPPLKKSPKQTGYGWICQECDSSSSKEDENEAERKNISQELNMEQKNPKK

SEQ ID NO: 62276 - protein, 207 aa, Homo sapiens
  Payload ID: 12450
  Gene Symbol: PHF19
  Gene Name: PHD finger protein 19
  Uniprot ID: Q5T6S3
  ENSP ID: ENSP00000310372
MENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRVSLPSSPVPASPASSSGADQRLPSQSLSSKQKGHTWALETDSASATVLGQDL

SEQ ID NO: 62277 - protein, 580 aa, Homo sapiens
  Payload ID: 12450
  Gene Symbol: PHF19
  Gene Name: PHD finger protein 19
  Uniprot ID: Q5T6S3
  ENSP ID: ENSP00000363003
MENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRKGGALKKGAIARTLQAVKMVLSYQPEELEWDSPHRTNQQQCYCYCGGPGEWYLRMLQCYRCRQWFHEACTQCLNEPMMFGDRFYLFFCSVCNQGPEYIERLPLRWVDVVHLALYNLGVQSKKKYFDFEEILAFVNHHWELLQLGKLTSTPVTDRGPHLLNALNSYKSRFLCGKEIKKKKCIFRLRIRVPPNPPGKLLPDKGLLPNENSASSELRKRGKSKPGLLPHEFQQQKRRVYRRKRSKFLLEDAIPSSDFTSAWSTNHHLASIFDFTLDEIQSLKSASSGQTFFSDVDSTDAASTSGSASTSLSYDSRWTVGSRKRKLAAKAYMPLRAKRWAAELDGRCPSDSSAEGASVPERPDEGIDSHTFESISEDDSSLSHLKSSITNYFGAAGRLACGEKYQVLARRVTPEGKVQYLVEWEGTTPY

SEQ ID NO: 62278 - protein, 173 aa, Homo sapiens
  Payload ID: 12450
  Gene Symbol: PHF19
  Gene Name: PHD finger protein 19
  ENSP ID: ENSP00000395938
MLQCYRCRQWFHEACTQCLNEPMMFGDRFYLFFCSVCNQGPEYIERLPLRWVDVVHLALYNLGVQSKKKYFDFEEILAFVNHHWELLQLGKLTSTPVTDRGPHLLNALNSYKSRFLCGKEIKKKKCIFRLRIRVPPNPPGKLLPDKGLLPNENSASSELRKRGKSKPGLLPHE

SEQ ID NO: 62279 - protein, 106 aa, Homo sapiens
  Payload ID: 12450
  Gene Symbol: PHF19
  Gene Name: PHD finger protein 19
  ENSP ID: ENSP00000397935
MENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKT

SEQ ID NO: 62280 - protein, 60 aa, Homo sapiens
  Payload ID: 12450
  Gene Symbol: PHF19
  Gene Name: PHD finger protein 19
  ENSP ID: ENSP00000404655
MLQCYRCRQWFHEACTQCLNEPMMFGDRFYLFFCSVCNQGPEYIERLPLRWVDVVHLALY

SEQ ID NO: 62281 - protein, 371 aa, Homo sapiens
  Payload ID: 12450
  Gene Symbol: PHF19
  Gene Name: PHD finger protein 19
  ENSP ID: ENSP00000407433
MLQCYRCRQWFHEACTQCLNEPMMFGDRFYLFFCSVCNQGPEYIERLPLRWVDVVHLALYNLGVQSKKKYFDFEEILAFVNHHWELLQLGKLTSTPVTDRGPHLLNALNSYKSRFLCGKEIKKKKCIFRLRIRVPPNPPGKLLPDKGLLPNENSASSELRKRGKSKPGLLPHEFQQQKRRVYRRKRSKFLLEDAIPSSDFTSAWSTNHHLASIFDFTLDEIQSLKSASSGQTFFSDVDSTDAASTSGSASTSLSYDSRWTVGSRKRKLAAKAYMPLRAKRWAAELDGRCPSDSSAEGASVPERPDEGIDSHTFESISEDDSSLSHLKSSITNYFGAAGRLACGEKYQVLARRVTPEGKVQYLVEWEGTTPY

SEQ ID NO: 62282 - protein, 165 aa, Homo sapiens
  Payload ID: 12450
  Gene Symbol: PHF19
  Gene Name: PHD finger protein 19
  ENSP ID: ENSP00000408479
MENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRKGGALKKGAI

SEQ ID NO: 62283 - protein, 599 aa, Homo sapiens
  Payload ID: 12450
  Gene Symbol: PHF19
  Gene Name: PHD finger protein 19
  ENSP ID: ENSP00000483946
MLVLVIRGPYPSAQCQGKLMENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRKGGALKKGAIARTLQAVKMVLSYQPEELEWDSPHRTNQQQCYCYCGGPGEWYLRMLQCYRCRQWFHEACTQCLNEPMMFGDRFYLFFCSVCNQGPEYIERLPLRWVDVVHLALYNLGVQSKKKYFDFEEILAFVNHHWELLQLGKLTSTPVTDRGPHLLNALNSYKSRFLCGKEIKKKKCIFRLRIRVPPNPPGKLLPDKGLLPNENSASSELRKRGKSKPGLLPHEFQQQKRRVYRRKRSKFLLEDAIPSSDFTSAWSTNHHLASIFDFTLDEIQSLKSASSGQTFFSDVDSTDAASTSGSASTSLSYDSRWTVGSRKRKLAAKAYMPLRAKRWAAELDGRCPSDSSAEGASVPERPDEGIDSHTFESISEDDSSLSHLKSSITNYFGAAGRLACGEKYQVLARRVTPEGKVQYLVEWEGTTPY

SEQ ID NO: 62284 - protein, 1096 aa, Homo sapiens
  Payload ID: 12451
  Gene Symbol: PHF2
  Gene Name: PHD finger protein 2
  Uniprot ID: O75151
  ENSP ID: ENSP00000352185
MATVPVYCVCRLPYDVTRFMIECDACKDWFHGSCVGVEEEEAPDIDIYHCPNCEKTHGKSTLKKKRTWHKHGPGQAPDVKPVQNGSQLFIKELRSRTFPSAEDVVARVPGSQLTLGYMEEHGFTEPILVPKKDGLGLAVPAPTFYVSDVENYVGPERSVDVTDVTKQKDCKMKLKEFVDYYYSTNRKRVLNVTNLEFSDTRMSSFVEPPDIVKKLSWVENYWPDDALLAKPKVTKYCLICVKDSYTDFHIDSGGASAWYHVLKGEKTFYLIRPASANISLYERWRSASNHSEMFFADQVDKCYKCIVKQGQTLFIPSGWIYATLTPVDCLAFAGHFLHSLSVEMQMRAYEVERRLKLGSLTQFPNFETACWYMGKHLLEAFKGSHKSGKQLPPHLVQGAKILNGAFRSWTKKQALAEHEDELPEHFKPSQLIKDLAKEIRLSENASKAVRPEVNTVASSDEVCDGDREKEEPPSPIEATPPQSLLEKVSKKKTPKTVKMPKPSKIPKPPKPPKPPRPPKTLKLKDGGKKKGKKSRESASPTIPNLDLLEAHTKEALTKMEPPKKGKATKSVLSVPNKDVVHMQNDVERLEIREQTKSKSEAKWKYKNSKPDSLLKMEEEQKLEKSPLAGNKDNKFSFSFSNKKLLGSKALRPPTSPGVFGALQNFKEDKPKPVRDEYEYVSDDGELKIDEFPIRRKKNAPKRDLSFLLDKKAVLPTPVTKPKLDSAAYKSDDSSDEGSLHIDTDTKPGRNARVKKESGSSAAGILDLLQASEEVGALEYNPSSQPPASPSTQEAIQGMLSMANLQASDSCLQTTWGAGQAKGSSLAAHGARKNGGGSGKSAGKRLLKRAAKNSVDLDDYEEEQDHLDACFKDSDYVYPSLESDEDNPIFKSRSKKRKGSDDAPYSPTARVGPSVPRQDRPVREGTRVASIETGLAAAAAKLSQQEEQKSKKKKSAKRKLTPNTTSPSTSTSISAGTTSTSTTPASTTPASTTPASTSTASSQASQEGSSPEPPPESHSSSLADHEYTAAGTFTGAQAGRTSQPMAPGVFLTQRRPSASSPNNNTAAKGKRTKKGMATAKQRLGKILKIHRNGKLLL

SEQ ID NO: 62285 - protein, 309 aa, Homo sapiens [sequence omitted]

SEQ ID NO: 62286 - protein, 328 aa, Homo sapiens
  Payload ID: 12451
  Gene Symbol: PHF2
  Gene Name: PHD finger protein 2
  ENSP ID: ENSP00000479936
MATVPVYCVCRLPYDVTRFMIECDACKDWFHGSCVGVEEEEAPDIDIYHCPNCEKTHGKSTLKKKRTWHKHGPGQAPDVKAAKNSVDLDDYEEEQDHLDACFKDSDYVYPSLESDEDNPIFKSRSKKRKGSDDAPYSPTARVGPSVPRQDRPVREGTRVASIETGLAAAAAKLSQQEEQKSKKKKSAKRKLTPNTTSPSTSTSISAGTTSTSTTPASTTPASTTPASTSTASSQASQEGSSPEPPPESHSSSLADHEYTAAGTFTGAQAGRTSQPMAPGVFLTQRRPSASSPNNNTAAKGKRTKKGMATAKQRLGKILKIHRNGKLLL

SEQ ID NO: 62287 - protein, 543 aa, Homo sapiens
  Payload ID: 12452
  Gene Symbol: PHF20
  Gene Name: PHD finger protein 20
  ENSP ID: ENSP00000341900
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKK

SEQ ID NO: 62288 - protein, 549 aa, Homo sapiens
  Payload ID: 12452
  Gene Symbol: PHF20
  Gene Name: PHD finger protein 20
  ENSP ID: ENSP00000363112
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKK

SEQ ID NO: 62289 - protein, 1012 aa, Homo sapiens
  Payload ID: 12452
  Gene Symbol: PHF20
  Gene Name: PHD finger protein 20
  Uniprot ID: Q9BVI0
  ENSP ID: ENSP00000363124
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVTTNPDEELDGDDRYDFEVVRCICEVQEENDFMIQCEECQCWQHGVCMGLLEENVPEKYTCYVCQDPPGQRPGFKYWYDKEWLSRGHMHGLAFLEENYSHQNAKKIVATHQLLGDVQRVIEVLHGLQLKMSILQSREHPDLPLWCQPWKQHSGEGRSHFRNIPVTDTRSKEEAPSYRTLNGAVEKPRPLALPLPRSVEESYITSEHCYQKPRAYYPAVEQKLVVETRGSALDDAVNPLHENGDDSLSPRLGWPLDQDRSKGDSDPKPGSPKVKEYVSKKALPEEAPARKLLDRGGEGLLSSQHQWQFNLLTHVESLQDEVTHRMDSIEKELDVLESWLDYTGELEPPEPLARLPQLKHCIKQLLMDLGKVQQIALCCST

SEQ ID NO: 62290 - protein, 154 aa, Homo sapiens
  Payload ID: 12452
  Gene Symbol: PHF20
  Gene Name: PHD finger protein 20
  ENSP ID: ENSP00000391915
MVQVNHGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRG

SEQ ID NO: 62291 - protein, 103 aa, Homo sapiens
  Payload ID: 12452
  Gene Symbol: PHF20
  Gene Name: PHD finger protein 20
  ENSP ID: ENSP00000404455
MTKHPPNRRGISFEVGAQLEARDRLKNWYPAHIEDIDYEEGKVLIHFKRWNHRYDEWFCWDSPYLRPLEKIQLRKEGLHEEDGSSRRFLALSPSLKCSGAVLA

SEQ ID NO: 62292 - protein, 638 aa, Homo sapiens
  Payload ID: 12452
  Gene Symbol: PHF20
  Gene Name: PHD finger protein 20
  ENSP ID: ENSP00000410373
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVHQPR

SEQ ID NO: 62293 - protein, 64 aa, Homo sapiens
  Payload ID: 12452
  Gene Symbol: PHF20
  Gene Name: PHD finger protein 20
  ENSP ID: ENSP00000413712
MFLFGEEDNLSESSSESFLWSDDEYGQDVDVTTNPDEELDGDDRYDFEVVRCICEVQEENDFMI

SEQ ID NO: 62294 - protein, 991 aa, Homo sapiens
  Payload ID: 12453
  Gene Symbol: PHF20L1
  Gene Name: PHD finger protein 20-like 1
  ENSP ID: ENSP00000220847
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 62295 - protein, 285 aa, Homo sapiens
  Payload ID: 12453
  Gene Symbol: PHF20L1
  Gene Name: PHD finger protein 20-like 1
  Uniprot ID: A8MW92
  ENSP ID: ENSP00000338269
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQV

SEQ ID NO: 62296 - protein, 316 aa, Homo sapiens
  Payload ID: 12453
  Gene Symbol: PHF20L1
  Gene Name: PHD finger protein 20-like 1
  ENSP ID: ENSP00000378775
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQFLFQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFVGLHVENVPKMVFPQPESTLSNKRKNNQGNSFQAKRARLNKITGLLASKAVGVDGAEKKEDYNETAPMLEQV

SEQ ID NO: 62297 - protein, 311 aa, Homo sapiens
  Payload ID: 12453
  Gene Symbol: PHF20L1
  Gene Name: PHD finger protein 20-like 1
  ENSP ID: ENSP00000378777
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQV

SEQ ID NO: 62298 - protein, 1017 aa, Homo sapiens
  Payload ID: 12453
  Gene Symbol: PHF20L1
  Gene Name: PHD finger protein 20-like 1
  Uniprot ID: A8MW92
  ENSP ID: ENSP00000378784
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 62299 - protein, 992 aa, Homo sapiens
  Payload ID: 12453
  Gene Symbol: PHF20L1
  Gene Name: PHD finger protein 20-like 1
  ENSP ID: ENSP00000378788
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFVGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGKRKEKDKERREKRDKDHYRPKQKKKKKKKKKSKQHDYSDYEDSSLEFLERCSSPLTRSSGSSLASRSMFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 62300 - protein, 86 aa, Homo sapiens
  Payload ID: 12453
  Gene Symbol: PHF20L1
  Gene Name: PHD finger protein 20-like 1
  ENSP ID: ENSP00000428091
MLVHFERWSHRYDEWIYWDSNRLRPLERPALRKEGLKDEEDFFDFKAGEEVLARWTDCRYYPAKIEAINKEGTFTVQFYDGVIRCL

SEQ ID NO: 62301 - protein, 112 aa, Homo sapiens
  Payload ID: 12453
  Gene Symbol: PHF20L1
  Gene Name: PHD finger protein 20-like 1
  ENSP ID: ENSP00000430688
  MOD_RES (1)..(1): Any amino acid
XMGSEDWIALVKAAAAAAAKNKTGSKPRTSANSNKDKDKDERKWFKVPSKKEETSTCIATPDVEKKEDLPTSSETFDKLSYMCSVESRTSCRERSKDGLSTAREHIIKQEEK

SEQ ID NO: 62302 - protein, 264 aa, Homo sapiens
  Payload ID: 12453
  Gene Symbol: PHF20L1
  Gene Name: PHD finger protein 20-like 1
  ENSP ID: ENSP00000433125
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGRDQLCIL

SEQ ID NO: 62303 - protein, 93 aa, Homo sapiens
  Payload ID: 12453
  Gene Symbol: PHF20L1
  Gene Name: PHD finger protein 20-like 1
  ENSP ID: ENSP00000433524
  MOD_RES (1)..(1): Any amino acid
XEVTAPVASDSSYRNECPRAEKEDTQMLPNPSSKAIADGRGAPAAAGISKTEKKVKLEDKSSTAFGIRSWDFSALLMKIPSYSPISLSGLPES

SEQ ID NO: 62304 - protein, 1017 aa, Homo sapiens; identical to SEQ ID NO: 62298
  Payload ID: 12453
  Gene Symbol: PHF20L1
  Gene Name: PHD finger protein 20-like 1
  Uniprot ID: A8MW92
  ENSP ID: ENSP00000482945

SEQ ID NO: 62305 - protein, 160 aa, Homo sapiens
  Payload ID: 12453
  Gene Symbol: PHF20L1
  Gene Name: PHD finger protein 20-like 1
  ENSP ID: ENSP00000487068
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVRVFSIPSYPKGYLLER

SEQ ID NO: 62306 - protein, 634 aa, Homo sapiens
  Payload ID: 12454
  Gene Symbol: PHF21A
  Gene Name: PHD finger protein 21A
  Uniprot ID: Q96BD5
  ENSP ID: ENSP00000323152
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRANEEHWPKGDIHEDFCSVCRKSGQLLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISKCMEMKNTILARQKEMHSSLEKVKQLIRLIHGIDLSKPVDSEATVGAISNGPDCTPPANAATSTPAPSPSSQSCTANCNQGEETK

SEQ ID NO: 62307 - protein, 680 aa, Homo sapiens
  Payload ID: 12454
  Gene Symbol: PHF21A
  Gene Name: PHD finger protein 21A
  Uniprot ID: Q96BD5
  ENSP ID: ENSP00000398824
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRGRPPKYNAVLGFGALTPTSPQSSHPDSPENEKTETTFTFPAPVQPVSLPSPTSTDGDIHEDFCSVCRKSGQLLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISKCMEMKNTILARQKEMHSSLEKVKQLIRLIHGIDLSKPVDSEATVGAISNGPDCTPPANAATSTPAPSPSSQSCTANCNQGEETK

SEQ ID NO: 62308 - protein, 134 aa, Homo sapiens
  Payload ID: 12454
  Gene Symbol: PHF21A
  Gene Name: PHD finger protein 21A
  ENSP ID: ENSP00000431273
MELQTLQEALKVEIQVHQKLVAQMKQDPQIFFLSNQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTAS

SEQ ID NO: 62309 - protein, 150 aa, Homo sapiens
  Payload ID: 12454
  Gene Symbol: PHF21A
  Gene Name: PHD finger protein 21A
  ENSP ID: ENSP00000431621
VSLPSPTSTDMLKKEEAIPWPGTLAIVHSYIAYKAAKEEEKQKLLKWSSDLKQEREQLEQKVKQLSNSISKCMEMKNTILARQKEMHSSLEKVKQLIRLIHGIDLSKPVDSEATVGAISNGPDCTPPANAATSTPAPSPSSQSCTANCNQ

SEQ ID NO: 62310 - protein, 93 aa, Homo sapiens
  Payload ID: 12454
  Gene Symbol: PHF21A
  Gene Name: PHD finger protein 21A
  ENSP ID: ENSP00000431964
  MOD_RES (1)..(1): Any amino acid
XAYKAAKEEEKQKLLKWSSDLKQEREQLEQKVKQLSNSISCEEAGFLETSIGKMHGNEEHHPGPAEGDAQLPGEGKTADSPHPRHRPLQTCRL

SEQ ID NO: 62311 - protein, 82 aa, Homo sapiens
  Payload ID: 12454
  Gene Symbol: PHF21A
  Gene Name: PHD finger protein 21A
  ENSP ID: ENSP00000432094
MELQTLQEALKVEIQVHQKLVAQMKQDPQNADLKKQLHELQAKITALSEKQKPSVSLYQFYLACRCHCTGIHCVEASLCLTY

SEQ ID NO: 62312 - protein, 51 aa, Homo sapiens
  Payload ID: 12454
  Gene Symbol: PHF21A
  Gene Name: PHD finger protein 21A
  ENSP ID: ENSP00000432406
MELQTLQEALKVEIQVHQKLVAQMKQDPQNADLKKQLHELQAKITALSEKQ

SEQ ID NO: 62313 - protein, 133 aa, Homo sapiens
  Payload ID: 12454
  Gene Symbol: PHF21A
  Gene Name: PHD finger protein 21A
  ENSP ID: ENSP00000432916
MELQTLQEALKVEIQVHQKLVAQMKQDPQIFFLSNQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTA

SEQ ID NO: 62314 - protein, 11 aa, Homo sapiens
  Payload ID: 12454
  Gene Symbol: PHF21A
  Gene Name: PHD finger protein 21A
  ENSP ID: ENSP00000434687
MELQTLQEALK

SEQ ID NO: 62315 - protein, 62 aa, Homo sapiens
  Payload ID: 12454
  Gene Symbol: PHF21A
  Gene Name: PHD finger protein 21A
  ENSP ID: ENSP00000435121
MKQDPQNADLKKQLHELQAKITALSEKQKRVVEQLRKNLIVKQEQPDKFQIQPLPQSENKLQ

SEQ ID NO: 62316 - protein, 9 aa, Homo sapiens
  Payload ID: 12454
  Gene Symbol: PHF21A
  Gene Name: PHD finger protein 21A
  ENSP ID: ENSP00000435645
MELQTLQEA

SEQ ID NO: 62317 - protein, 116 aa, Homo sapiens
  Payload ID: 12454
  Gene Symbol: PHF21A
  Gene Name: PHD finger protein 21A
  ENSP ID: ENSP00000435984
LLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISSPERVGPSVRPSLALSSTPC

SEQ ID NO: 62318 - protein, 101 aa, Homo sapiens
  Payload ID: 12454
  Gene Symbol: PHF21A
  Gene Name: PHD finger protein 21A
  ENSP ID: ENSP00000436157
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQY

SEQ ID NO: 62319 - protein, 26 aa, Homo sapiens
  Payload ID: 12454
  Gene Symbol: PHF21A
  Gene Name: PHD finger protein 21A
  ENSP ID: ENSP00000437110
MELQTLQEALKVEIQVHQKLVAQMKQ

SEQ ID NO: 62320 - protein, 531 aa, Homo sapiens
  Payload ID: 12455
  Gene Symbol: PHF21B
  Gene Name: PHD finger protein 21B
  Uniprot ID: Q96EK2
  ENSP ID: ENSP00000324403
MELQSRPEALAVELARHQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKPPPRLLSSPHPATHHCPLHPSSLPLTPPSPSLSPSPLHGIFQVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 62321 - protein, 477 aa, Homo sapiens
  Payload ID: 12455
  Gene Symbol: PHF21B
  Gene Name: PHD finger protein 21B
  Uniprot ID: Q96EK2
  ENSP ID: ENSP00000379410
MRRQPQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 62322 - protein, 327 aa, Homo sapiens
  Payload ID: 12455
  Gene Symbol: PHF21B
  Gene Name: PHD finger protein 21B
  ENSP ID: ENSP00000385053
MAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 62323 - protein, 137 aa, Homo sapiens
  Payload ID: 12455
  Gene Symbol: PHF21B
  Gene Name: PHD finger protein 21B
  ENSP ID: ENSP00000401091
MAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANE

SEQ ID NO: 62324 - protein, 191 aa, Homo sapiens
  Payload ID: 12455
  Gene Symbol: PHF21B
  Gene Name: PHD finger protein 21B
  ENSP ID: ENSP00000401294
MRRQPQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKVIIIQPQVQTQPEST

SEQ ID NO: 62325 - protein, 489 aa, Homo sapiens
  Payload ID: 12455
  Gene Symbol: PHF21B
  Gene Name: PHD finger protein 21B
  Uniprot ID: Q96EK2
  ENSP ID: ENSP00000487086
MELQSRPEALAVELARHQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 62326 - protein, 403 aa, Homo sapiens
  Payload ID: 12456
  Gene Symbol: PHF23
  Gene Name: PHD finger protein 23
  Uniprot ID: Q9BUL5
  ENSP ID: ENSP00000322579
MLEAMAEPSPEDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 62327 - protein, 399 aa, Homo sapiens
  Payload ID: 12456
  Gene Symbol: PHF23
  Gene Name: PHD finger protein 23
  Uniprot ID: Q9BUL5
  ENSP ID: ENSP00000414607
MPGDCRRDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 62328 - protein, 36 aa, Homo sapiens
  Payload ID: 12456
  Gene Symbol: PHF23
  Gene Name: PHD finger protein 23
  ENSP ID: ENSP00000458401
MKLKDSLFDLDGPKVASPLSPTSLTHTSRPPAALTP

SEQ ID NO: 62329 - protein, 186 aa, Homo sapiens
  Payload ID: 12456
  Gene Symbol: PHF23
  Gene Name: PHD finger protein 23
  ENSP ID: ENSP00000458416
MRSLFRCSRTDYKTLDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPLSPTSLTHTSRPPAALTPVPLSQGDLSHPPRKKD

SEQ ID NO: 62330 - protein, 273 aa, Homo sapiens
  Payload ID: 12456
  Gene Symbol: PHF23
  Gene Name: PHD finger protein 23
  ENSP ID: ENSP00000458953
MKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 62331 - protein, 6 aa, Homo sapiens
  Payload ID: 12456
  Gene Symbol: PHF23
  Gene Name: PHD finger protein 23
  ENSP ID: ENSP00000459904
MKLKDS

SEQ ID NO: 62332 - protein, 59 aa, Homo sapiens
  Payload ID: 12456
  Gene Symbol: PHF23
  Gene Name: PHD finger protein 23
  ENSP ID: ENSP00000459983
MKLKDSLFDLDGPKVASPLSPTSLTHTSRPPAALTPVPLSQGDLSHPPRKKDRKNRKLG

SEQ ID NO: 62333 - protein, 336 aa, Homo sapiens
  Payload ID: 12456
  Gene Symbol: PHF23
  Gene Name: PHD finger protein 23
  Uniprot ID: Q9BUL5
  ENSP ID: ENSP00000460738
MLEAMAEPSPEDPPPTLKPETQPPEKRRRTIEDFNKFCSFVLAYAGYIPPSKEAPDSATLLEKMKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 62334 - protein, 201 aa, Homo sapiens
  Payload ID: 12456
  Gene Symbol: PHF23
  Gene Name: PHD finger protein 23
  ENSP ID: ENSP00000460876
MKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVE

SEQ ID NO: 62335 - protein, 203 aa, Homo sapiens
  Payload ID: 12456
  Gene Symbol: PHF23
  Gene Name: PHD finger protein 23
  ENSP ID: ENSP00000461442
MPDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPLSPTSLTHTSRPPAALTPVPLSQGDLSHPPRKKDRKNRKLGPGAGAGFGVLRRPRPTPGDGEKR

SEQ ID NO: 62336 - protein, 158 aa, Homo sapiens
  Payload ID: 12456
  Gene Symbol: PHF23
  Gene Name: PHD finger protein 23
  ENSP ID: ENSP00000479592
MLEAMAEPSPEDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPFPSPCAANTP

SEQ ID NO: 62337 - protein, 400 aa, Homo sapiens
  Payload ID: 12457
  Gene Symbol: PHF24
  Gene Name: PHD finger protein 24
  Uniprot ID: Q9UPV7
  ENSP ID: ENSP00000242315
MGVLMSKRQTVEQVQKVSLAVSAFKDGLRDRPSIRRTGELPGSRRGTVEGSVQEVQEEKEAEAGTSVVQEESSAGRAAWERLRDGRGVEPEEFDRTSRFTPPAFIRPTRKLDDDKPPEICLEPREPVVNDEMCDVCEVWTAESLFPCRVCTRVFHDGCLRRMGYIQGDSAAEVTEMAHTETGWSCHYCDNINLLLTEEEMYSLTETFQRCKVIPDCSLTLEDFLRYRHQAAKRGDRDRALSEEQEEQAARQFAALDPEHRGHIEWPDFLSHESLLLLQQLRPQNSLLRLLTVKERERARAAFLARGSGSTVSEAECRRAQHSWFCKRFPEAPSCSVSISHVGPIADSSPASSSSKSQDKTLLPTEQESRFVDWPTFLQENVLYILAARPNSAAIHLKPPG

SEQ ID NO: 62338 - protein, 2039 aa, Homo sapiens
  Payload ID: 12458
  Gene Symbol: PHF3
  Gene Name: PHD finger protein 3
  Uniprot ID: Q92576
  ENSP ID: ENSP00000262043
MDIVDTFNHLIPTEHLDDALFLGSNLENEVCEDFSASQNVLEDSLKNMLSDKDPMLGSASNQFCLPVLDSNDPNFQMPCSTVVGLDDIMDEGVVKESGNDTIDEEELILPNRNLRDKVEENSVRSPRKSPRLMAQEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEMKKKKVEKGVLNVHPAASASKPSADQIRQSVRHSLKDILMKRLTDSNLKVPEEKAAKVATKIEKELFSFFRDTDAKYKNKYRSLMFNLKDPKNNILFKKVLKGEVTPDHLIRMSPEELASKELAAWRRRENRHTIEMIEKEQREVERRPITKITHKGEIEIESDAPMKEQEAAMEIQEPAANKSLEKPEGSEKQKEEVDSMSKDTTSQHRQHLFDLNCKICIGRMAPPVDDLSPKKVKVVVGVARKHSDNEAESIADALSSTSNILASEFFEEEKQESPKSTFSPAPRPEMPGTVEVESTFLARLNFIWKGFINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGLELHRPNLLLGLIIRQKLKRQHSACASTSHIAETPESAPPIALPPDKKSKIEVSTEEAPEEENDFFNSFTTVLHKQRNKPQQNLQEDLPTAVEPLMEVTKQEPPKPLRFLPGVLIGWENQPTTLELANKPLPVDDILQSLLGTTGQVYDQAQSVMEQNTVKEIPFLNEQTNSKIEKTDNVEVTDGENKEIKVKVDNISESTDKSAEIETSVVGSSSISAGSLTSLSLRGKPPDVSTEAFLTNLSIQSKQEETVESKEKTLKRQLQEDQENNLQDNQTSNSSPCRSNVGKGNIDGNVSCSENLVANTARSPQFINLKRDPRQAAGRSQPVTTSESKDGDSCRNGEKHMLPGLSHNKEHLTEQINVEEKLCSAEKNSCVQQSDNLKVAQNSPSVENIQTSQAEQAKPLQEDILMQNIETVHPFRRGSAVATSHFEVGNTCPSEFPSKSITFTSRSTSPRTSTNFSPMRPQQPNLQHLKSSPPGFPFPGPPNFPPQSMFGFPPHLPPPLLPPPGFGFAQNPMVPWPPVVHLPGQPQRMMGPLSQASRYIGPQNFYQVKDIRRPERRHSDPWGRQDQQQLDRPFNRGKGDRQRFYSDSHHLKRERHEKEWEQESERHRRRDRSQDKDRDRKSREEGHKDKERARLSHGDRGTDGKASRDSRNVDKKPDKPKSEDYEKDKEREKSKHREGEKDRDRYHKDRDHTDRTKSKR

SEQ ID NO: 62339 - protein, 2039 aa, Homo sapiens; identical to SEQ ID NO: 62338
  Payload ID: 12458
  Gene Symbol: PHF3
  Gene Name: PHD finger protein 3
  Uniprot ID: Q92576
  ENSP ID: ENSP00000377048

SEQ ID NO: 62340 - protein, 169 aa, Homo sapiens
  Payload ID: 12458
  Gene Symbol: PHF3
  Gene Name: PHD finger protein 3
  ENSP ID: ENSP00000421417
  MOD_RES (1)..(1): Any amino acid
XINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGRSMTLANTASSIWVALRISQSSEMAILLSANLKSENTALKKCKNTSC

SEQ ID NO: 62341 - protein, 736 aa, Homo sapiens
  Payload ID: 12458
  Gene Symbol: PHF3
  Gene Name: PHD finger protein 3
  ENSP ID: ENSP00000422841
MDIVDTFNHLIPTEHLDDALFLGSNLENEVCEDFSASQNVLEDSLKNMLSDKDPMLGSASNQFCLPVLDSNDPNFQMPCSTVVGLDDIMDEGVVKESGNDTIDEEELILPNRNLRDKVEENSVRSPRKSPRLMAQEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRCVCMCV

SEQ ID NO: 62342 - protein, 821 aa, Homo sapiens
  Payload ID: 12458
  Gene Symbol: PHF3
  Gene Name: PHD finger protein 3
  ENSP ID: ENSP00000424078
MLSDKDPMLGSASNQFCLPVLDSNDPNFQMPCSTVVGLDDIMDEGVVKESGNDTIDEEELILPNRNLRDKVEENSVRSPRKSPRLMAQEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRS

SEQ ID NO: 62343 - protein, 104 aa, Homo sapiens
  Payload ID: 12458
  Gene Symbol: PHF3
  Gene Name: PHD finger protein 3
  ENSP ID: ENSP00000424197
MLENFTFQIFKIVGLDDIMDEGVVKESGNDTIDEEELILPNRNLRDKVEENSVRSPRKSPRLMAQEQVRSLRQSTIAKRSNAAPLSNTKKASGKTVSTAKAGVK

SEQ ID NO: 62344 - protein, 1072 aa, Homo sapiens
  Payload ID: 12458
  Gene Symbol: PHF3
  Gene Name: PHD finger protein 3
  ENSP ID: ENSP00000424694
MSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEMKKKKVEKGVLNVHPAASASKPSADQIRQSVRHSLKDILMKRLTDSNLKVPEEKAAKVATKIEKELFSFFRDTDAKYKNKYRSLMFNLKDPKNNILFKKVLKGEVTPDHLIRMSPEELASKELAAWRRRENRHTIEMIEKEQREVERRPITKITHKGEIEIESDAPMKEQEAAMEIQEPAANKSLEKPEGSEKQKEEVDSMSKDTTSQHRQHLFDLNCKICIGRMAPPVDDLSPKKVKVVVGVARKHSDNEAESIADALSSTSNILASEFFEEEKQESPKSTFSPAPRPEMPGTVEVESTFLARLNFIWKGFINMPSVAKFVTKAYPVSGSPEYLTEDLPDSIQVGGRISPQTVWDYV

SEQ ID NO: 62345 - protein, 82 aa, Homo sapiens
  Payload ID: 12458
  Gene Symbol: PHF3
  Gene Name: PHD finger protein 3
  ENSP ID: ENSP00000424994
MDIVDTFNHLIPTEHLDDALFLGSNLENEVCEDFSASQNVLEDSLKNMLSDKDPMLGSASNQFCLPVLDSNDPNFQMPCSTG

SEQ ID NO: 62346 - protein, 813 aa, Homo sapiens
  Payload ID: 12458
  Gene Symbol: PHF3
  Gene Name: PHD finger protein 3
  ENSP ID: ENSP00000425227
MDEGVVKESGNDTIDEEELILPNRNLRDKVEENSVRSPRKSPRLMAQEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEM

SEQ ID NO: 62347 - protein, 860 aa, Homo sapiens
  Payload ID: 12458
  Gene Symbol: PHF3
  Gene Name: PHD finger protein 3
  ENSP ID: ENSP00000425338
MVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEMKKKKVEKGVLNVHPAASASKPSADQIRQSVRHSLKDILMKRLTDSNLKVPEEKAAKVATKIEKELFSFFRDTDAKYKNKYRSLMFNLKDPKNNILFKKVLKGEVTPDHLIRMSPEELASKELAAWRRRENRHTIEMIEKEQREVERRPITKITHKGEIEIESDAPMKEQEAAMEIQEPAANKSLEKPEGSEKQKEEVDSMSKDTTSQHRQHLFDLNCKICIGRMAPPVDDLSPKKVKVVVGVARKHSDNEAESIADALSSTSNILASEFFEEEKQESPKSTFSPAPRPEMPGTVEVESTFLARLNFIWKGFINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGLELHRPNLLLGLIIRQKLKRQHSACASTSHIAETPESAPPIALPPDKKSKIEVSTEEAPEEENDFFNSFTTVLHKQRNKPQQNLQEDLPTAVEPLMEVTKQEPPKPLRFLPGVLIGWENQPTTLELANKPLPVDDILQSLLGTTGQVYDQAQSVMEQNTVKEIPFLNEQTNSKIEKTDNVEVTDGENKEIKVKVDNISESTDKSAEIETSVVGSSSISAGSLTSLSLRGKPPDVSTEAFLTNLSIQSKQEETVESKEK

SEQ ID NO: 62348 - protein, 110 aa, Homo sapiens
  Payload ID: 12459
  Gene Symbol: PHF5A
  Gene Name: PHD finger protein 5A
  Uniprot ID: Q7RTV0
  ENSP ID: ENSP00000216252
MAKHHPDLIFCRKQAGVAIGRLCEKCDGKCVICDSYVRPCTLVRICDECNYGSYQGRCVICGGPGVSDAYYCKECTIQEKDRDGCPKIVNLGSSKTDLFYERKKYGFKKR

SEQ ID NO: 62349 - protein, 365 aa, Homo sapiens
  Payload ID: 12460
  Gene Symbol: PHF6
  Gene Name: PHD finger protein 6
  Uniprot ID: Q8IWS0
  ENSP ID: ENSP00000329097
MSSSVEQKKGPTRQRKCGFCKSNRDKECGQLLISENQKVAAHHKCMLFSSALVSSHSDNESLGGFSIEDVQKEIKRGTKLMCSLCHCPGATIGCDVKTCHRTYHYHCALHDKAQIREKPSQGIYMVYCRKHKKTAHNSEADLEESFNEHELEPSSPKSKKKSRKGRPRKTNFKGLSEDTRSTSSHGTDEMESSSYRDRSPHRSSPSDTRPKCGFCHVGEEENEARGKLHIFNAKKAAAHYKCMLFSSGTVQLTTTSRAEFGDFDIKTVLQEIKRGKRMKCTLCSQPGATIGCEIKACVKTYHYHCGVQDKAKYIENMSRGIYKLYCKNHSGNDERDEEDEERESKSRGKVEIDQQQLTQQQLNGN

SEQ ID NO: 62350 - protein, 324 aa, Homo sapiens
  Payload ID: 12460
  Gene Symbol: PHF6
  Gene Name: PHD finger protein 6
  ENSP ID: ENSP00000359835
MSSSVEQKKGPTRQRKCGFCKSNRDKECGQLLISENQKVAAHHKCMLFSSALVSSHSDNESLGGFSIEDVQKEIKRGTKLMCSLCHCPGATIGCDVKTCHRTYHYHCALHDKAQIREKPSQGIYMVYCRKHKKTAHNSEAADLEESFNEHELEPSSPKSKKKSRKGRPRKTNFKGLSEDTRSTSSHGTDEMESSSYRDRSPHRSSPSDTRPKCGFCHVGEEENEARGKLHIFNAKKAAAHYKCMLFSSGTVQLTTTSRAEFGDFDIKTVLQEIKRGKRMKCTLCSQPGATIGCEIKACVKTYHYHCGVQDKAKYIENMSRGIYK

SEQ ID NO: 62351 - protein, 312 aa, Homo sapiens
  Payload ID: 12460
  Gene Symbol: PHF6
  Gene Name: PHD finger protein 6
  Uniprot ID: Q8IWS0
  ENSP ID: ENSP00000359836
MSSSVEQKKGPTRQRKCGFCKSNRDKECGQLLISENQKVAAHHKCMLFSSALVSSHSDNESLGGFSIEDVQKEIKRGTKLMCSLCHCPGATIGCDVKTCHRTYHYHCALHDKAQIREKPSQGIYMVYCRKHKKTAHNSEAADLEESFNEHELEPSSPKSKKKSRKGRPRKTNFKGLSEDTRSTSSHGTDEMESSSYRDRSPHRSSPSDTRPKCGFCHVGEEENEARGKLHIFNAKKAAAHYKCMLFSSGTVQLTTTSRAEFGDFDIKTVLQEIKRGKRMVCSFYICYATLHLICCFKFRVHPKFIQSSENLK

SEQ ID NO: 62352 - protein, 365 aa, Homo sapiens; identical to SEQ ID NO: 62349
  Payload ID: 12460
  Gene Symbol: PHF6
  Gene Name: PHD finger protein 6
  Uniprot ID: Q8IWS0
  ENSP ID: ENSP00000359839

SEQ ID NO: 62353 - protein, 366 aa, Homo sapiens
  Payload ID: 12460
  Gene Symbol: PHF6
  Gene Name: PHD finger protein 6
  ENSP ID: ENSP00000487420
MSSSVEQKKGPTRQRKCGFCKSNRDKECGQLLISENQKVAAHHKCMLFSSALVSSHSDNESLGGFSIEDVQKEIKRGTKLMCSLCHCPGATIGCDVKTCHRTYHYHCALHDKAQIREKPSQGIYMVYCRKHKKTAHNSEAADLEESFNEHELEPSSPKSKKKSRKGRPRKTNFKGLSEDTRSTSSHGTDEMESSSYRDRSPHRSSPSDTRPKCGFCHVGEEENEARGKLHIFNAKKAAAHYKCMLFSSGTVQLTTTSRAEFGDFDIKTVLQEIKRGKRMKCTLCSQPGATIGCEIKACVKTYHYHCGVQDKAKYIENMSRGIYKLYCKNHSGNDERDEEDEERESKSRGKVEIDQQQLTQQQLNGN

SEQ ID NO: 62354 - protein, 342 aa, Homo sapiens
  Payload ID: 12461
  Gene Symbol: PHF7
  Gene Name: PHD finger protein 7
  Uniprot ID: Q9BWX1
  ENSP ID: ENSP00000246282
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRRWCLILCATCGSHGTHRDCSSLRSNSKKWECEECSPAAATDYIPENSGDIPCCSSTFHPEEHFCRDNTLEENPGLSWTDWPEPSLLEKPESSRGRRSYSWRSKGVRITNSCKKSK

SEQ ID NO: 62355 - protein, 381 aa, Homo sapiens
  Payload ID: 12461
  Gene Symbol: PHF7
  Gene Name: PHD finger protein 7
  Uniprot ID: Q9BWX1
  ENSP ID: ENSP00000333024
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRDAAWELEPGAFSDLYQRYQHCDAPICLYEQGRDSFEDEGRWCLILCATCGSHGTHRDCSSLRSNSKKWECEECSPAAATDYIPENSGDIPCCSSTFHPEEHFCRDNTLEENPGLSWTDWPEPSLLEKPESSRGRRSYSWRSKGVRITNSCKKSK

SEQ ID NO: 62356 - protein, 326 aa, Homo sapiens
  Payload ID: 12461
  Gene Symbol: PHF7
  Gene Name: PHD finger protein 7
  ENSP ID: ENSP00000417712
  MOD_RES (1)..(1): Any amino acid
XDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRDAAWELEPGAFSDLYQRYQHCDAPICLYEQGRDSFEDEGRWCLILCATCGSHGTHRDCSSLRSNNYIPENSGDIPCCSSTFHPEEHFCRDNTLEENPGLSWTDWPEPSLLEKPESSRGRRSYSWRSKGVRITNSCKKSK

SEQ ID NO: 62357 - protein, 63 aa, Homo sapiens
  Payload ID: 12461
  Gene Symbol: PHF7
  Gene Name: PHD finger protein 7
  ENSP ID: ENSP00000420521
  MOD_RES (1)..(1): Any amino acid
XQQSVENIQSPCCSQAIYHRKCIQKYAHTSAKHFFKCPQCNNRKEFPQEMLRMGIHIPDRLHT

SEQ ID NO: 62358 - protein, 248 aa, Homo sapiens
  Payload ID: 12461
  Gene Symbol: PHF7
  Gene Name: PHD finger protein 7
  ENSP ID: ENSP00000478693
MKTVKEKKECQRLRKSAKTRRVTQRKPSSGPVCWLCLREPGDPEKLGEFLQKDNISVHYFCLILSSKLPQRGQSNRGSMDFCLKTSKRRQPGLLGRSALCARKRELLSTARRISASETSICLVAKKGVAFHNFLESTNHFVTNIAQHRTSNMGMWGRKAASYVVKTYPNRVLRTSRARVVVKPSTTASAYRNMPTHQQSISSNVHSVTIERVSSRNAENGNSYSRQEVVPHSVCYMRIPRNPQGLLLS

SEQ ID NO: 62359 - protein, 342 aa, Homo sapiens; identical to SEQ ID NO: 62354
  Payload ID: 12461
  Gene Symbol: PHF7
  Gene Name: PHD finger protein 7
  Uniprot ID: Q9BWX1
  ENSP ID: ENSP00000480003

SEQ ID NO: 62360 - protein, 213 aa, Homo sapiens [sequence omitted]

SEQ ID NO: 62361 - protein, 878 aa, Homo sapiens
  Payload ID: 12462
  Gene Symbol: PHF8
  Gene Name: PHD finger protein 8
  Uniprot ID: Q9UPP1
  ENSP ID: ENSP00000319473
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGYQTATPAPAQGASEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQVKKMKLSLTDSG

SEQ ID NO: 62362 - protein, 1024 aa, Homo sapiens
  Payload ID: 12462
  Gene Symbol: PHF8
  Gene Name: PHD finger protein 8
  Uniprot ID: Q9UPP1
  ENSP ID: ENSP00000338868
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLL

SEQ ID NO: 62363 - protein, 948 aa, Homo sapiens
  Payload ID: 12462
  Gene Symbol: PHF8
  Gene Name: PHD finger protein 8
  Uniprot ID: Q9UPP1
  ENSP ID: ENSP00000340051
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLLRQVIVQAECRQAIHEPKLKRRDAHP

SEQ ID NO: 62364 - protein, 1060 aa, Homo sapiens
  Payload ID: 12462
  Gene Symbol: PHF8
  Gene Name: PHD finger protein 8
  Uniprot ID: Q9UPP1
  ENSP ID: ENSP00000350676
MNRSRAIVQRGRVLPPPAPLDTTNLAGRRTLQGRAKMASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLL

SEQ ID NO: 62365 - protein, 953 aa, Homo sapiens
  Payload ID: 12462
  Gene Symbol: PHF8
  Gene Name: PHD finger protein 8
  ENSP ID: ENSP00000379578
  MOD_RES (1)..(1): Any amino acid
XSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLLRQVIVQAECRQAIHEPKLKRRDAHP

SEQ ID NO: 62366 - protein, 174 aa, Homo sapiens
  Payload ID: 12462
  Gene Symbol: PHF8
  Gene Name: PHD finger protein 8
  ENSP ID: ENSP00000388796
NEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEFSRGEDDYKAMFQQVAYTTRQ

SEQ ID NO: 62367 - protein, 659 aa, Homo sapiens
  Payload ID: 12462
  Gene Symbol: PHF8
  Gene Name: PHD finger protein 8
  ENSP ID: ENSP00000397129
  MOD_RES (1)..(1): Any amino acid
XSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQVKKMKLSLTDSG

SEQ ID NO: 62368 - protein, 115 aa, Homo sapiens
  Payload ID: 12462
  Gene Symbol: PHF8
  Gene Name: PHD finger protein 8
  ENSP ID: ENSP00000398995
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEF

SEQ ID NO: 62369 - protein, 114 aa, Homo sapiens
  Payload ID: 12462
  Gene Symbol: PHF8
  Gene Name: PHD finger protein 8
  ENSP ID: ENSP00000404117
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVE

SEQ ID NO: 62370 - protein, 148 aa, Homo sapiens
  Payload ID: 12462
  Gene Symbol: PHF8
  Gene Name: PHD finger protein 8
  ENSP ID: ENSP00000405897
MNRSRAIVQRGRVLPPPAPLDTTNLAGRRTLQGRAKMASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLT

SEQ ID NO: 62371 - protein, 126 aa, Homo sapiens
  Payload ID: 12462
  Gene Symbol: PHF8
  Gene Name: PHD finger protein 8
  ENSP ID: ENSP00000408113
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPIL

SEQ ID NO: 62372 - protein, 97 aa, Homo sapiens
  Payload ID: 12462
  Gene Symbol: PHF8
  Gene Name: PHD finger protein 8
  ENSP ID: ENSP00000410100
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFD

SEQ ID NO: 62373 - protein, 134 aa, Homo sapiens
  Payload ID: 12462
  Gene Symbol: PHF8
  Gene Name: PHD finger protein 8
  ENSP ID: ENSP00000414028
  MOD_RES (1)..(1): Any amino acid
XVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEFNITGACLNDSD

SEQ ID NO: 62374 - protein, 97 aa, Homo sapiens; identical to SEQ ID NO: 62372
  Payload ID: 12462
  Gene Symbol: PHF8
  Gene Name: PHD finger protein 8
  ENSP ID: ENSP00000416546

SEQ ID NO: 62375 - protein, 303 aa, Homo sapiens
  Payload ID: 12462
  Gene Symbol: PHF8
  Gene Name: PHD finger protein 8
  ENSP ID: ENSP00000482159
MDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRASLALTPTEFVNQEKLSLTLRRTIQQMRTWWKGLKASLGMVVALVAFLICSRPAGRWGDLTMLPSPRPQLLPALRRPSRACCAWPTCSPHRPHRLPLACRPGGLGDRIEAVGAPAVGWAQCLTVLLPSAPQGSGPSSGQHTGEPRARRRRRTPVWMNRTAWERASRMQSISILHWSLMMMTLL

SEQ ID NO: 62376 - protein, 288 aa, Homo sapiens
  Payload ID: 12463
  Gene Symbol: PBLD
  Gene Name: phenazine biosynthesis-like protein domain containing
  Uniprot ID: P30039
  ENSP ID: ENSP00000308466
MKLPIFIADAFTARAFRGNPAAVCLLENELDEDMHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGSAHAVLSSYWSQHLGKKEMHAFQCSHRGGELGISLRPDGRVDIRGGAAVVLEGTLTA

SEQ ID NO: 62377 - protein, 255 aa, Homo sapiens
  Payload ID: 12463
  Gene Symbol: PBLD
  Gene Name: phenazine biosynthesis-like protein domain containing
  ENSP ID: ENSP00000338041
MHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGSAHAVLSSYWSQHLGKKEMHAFQCSHRGGELGISLRPDGRVDIRGGAAVVLEGTLTA

SEQ ID NO: 62378 - protein, 288 aa, Homo sapiens; identical to SEQ ID NO: 62376
  Payload ID: 12463
  Gene Symbol: PBLD
  Gene Name: phenazine biosynthesis-like protein domain containing
  Uniprot ID: P30039
  ENSP ID: ENSP00000351619

SEQ ID NO: 62379 - protein, 90 aa, Homo sapiens
  Payload ID: 12463
  Gene Symbol: PBLD
  Gene Name: phenazine biosynthesis-like protein domain containing
  ENSP ID: ENSP00000476261
  MOD_RES (1)..(1): Any amino acid
XLLVRLSDVYNRSFLENLKVNTENLLQVENTGKVKGLILTLKGEPGGQTQAFDFYSRYFAPWVGVAEDPVTGTKTKNQDESRKLTQKSMY

SEQ ID NO: 62380 - protein, 280 aa, Homo sapiens
  Payload ID: 12463
  Gene Symbol: PBLD
  Gene Name: phenazine biosynthesis-like protein domain containing
  Uniprot ID: P30039
  ENSP ID: ENSP00000476306
MKLPIFIADAFTARAFRGNPAAVCLLENELDEDMHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGSAHAVLSSYWSQHLGKKEMHGRTALYQFLFYLPNSKLVFLLICTIPLKM

SEQ ID NO: 62381 - protein, 447 aa, Homo sapiens
  Payload ID: 12464
  Gene Symbol: PAH
  Gene Name: phenylalanine hydroxylase
  ENSP ID: ENSP00000303500
MSALTPTLVFCHMHVETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 62382 - protein, 117 aa, Homo sapiens
  Payload ID: 12464
  Gene Symbol: PAH
  Gene Name: phenylalanine hydroxylase
  ENSP ID: ENSP00000446658
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDT

SEQ ID NO: 62383 - protein, 136 aa, Homo sapiens
  Payload ID: 12464
  Gene Symbol: PAH
  Gene Name: phenylalanine hydroxylase
  ENSP ID: ENSP00000447620
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQIL

SEQ ID NO: 62384 - protein, 452 aa, Homo sapiens
  Payload ID: 12464
  Gene Symbol: PAH
  Gene Name: phenylalanine hydroxylase
  Uniprot ID: P00439
  ENSP ID: ENSP00000448059
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 62385 - protein, 149 aa, Homo sapiens
  Payload ID: 12464
  Gene Symbol: PAH
  Gene Name: phenylalanine hydroxylase
  ENSP ID: ENSP00000489016
  MOD_RES (1)..(1): Any amino acid
XENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPVSPWPVG

SEQ ID NO: 62386 - protein, 143 aa, Homo sapiens
  Payload ID: 12464
  Gene Symbol: PAH
  Gene Name: phenylalanine hydroxylase
  ENSP ID: ENSP00000489230
  MOD_RES (1)..(1): Any amino acid
XPDICHELLGHVPLFSDRSFAQFSQIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEI

SEQ ID NO: 62387 - protein, 451 aa, Homo sapiens
  Payload ID: 12465
  Gene Symbol: FARS2
  Gene Name: phenylalanyl-tRNA synthetase 2, mitochondrial
  Uniprot ID: O95363
  ENSP ID: ENSP00000274680
MVGSALRRGAHAYVYLVSKASHISRGHQHQAWGSRPPAAECATQRAPGSVVELLGKSYPQDDHSNLTRKVLTRVGRNLHNQQHHPLWLIKERVKEHFYKQYVGRFGTPLFSVYDNLSPVVTTWQNFDSLLIPADHPSRKKGDNYYLNRTHMLRAHTSAHQWDLLHAGLDAFLVVGDVYRRDQIDSQHYPIFHQLEAVRLFSKHELFAGIKDGESLQLFEQSSRSAHKQETHTMEAVKLVEFDLKQTLTRLMAHLFGDELEIRWVDCYFPFTHPSFEMEINFHGEWLEVLGCGVMEQQLVNSAGAQDRIGWAFGLGLERLAMILYDIPDIRLFWCEDERFLKQFCVSNINQKVKFQPLSKYPAVINDISFWLPSENYAENDFYDLVRTIGGDLVEKVDLIDKFVHPKTHKTSHCYRITYRHMERTLSQREVRHIHQALQEAAVQLLGVEGRF

SEQ ID NO: 62388 - protein, 451 aa, Homo sapiens; identical to SEQ ID NO: 62387
  Payload ID: 12465
  Gene Symbol: FARS2
  Gene Name: phenylalanyl-tRNA synthetase 2, mitochondrial
  Uniprot ID: O95363
  ENSP ID: ENSP00000316335

SEQ ID NO: 62389 - protein, 101 aa, Homo sapiens
  Payload ID: 12465
  Gene Symbol: FARS2
  Gene Name: phenylalanyl-tRNA synthetase 2, mitochondrial
  ENSP ID: ENSP00000392525
LFAGIKDGESLQLFEQSSRSAHKQETHTMEAVKLVEFDLKQTLTRLMAHLFGDELEIRWVDCYFPFTHPSFEMEINFHGEWLEVLGCGVMEQQLVNSGGAT

SEQ ID NO: 62390 - protein, 47 aa, Homo sapiens
  Payload ID: 12465
  Gene Symbol: FARS2
  Gene Name: phenylalanyl-tRNA synthetase 2, mitochondrial
  ENSP ID: ENSP00000473394
MVGSALRRGAHAYVYLVSKASHISRGHQHQAWGSRPPAAECATQRAP

SEQ ID NO: 62391 - protein, 508 aa, Homo sapiens
  Payload ID: 12466
  Gene Symbol: FARSA
  Gene Name: phenylalanyl-tRNA synthetase, alpha subunit
  Uniprot ID: Q9Y285
  ENSP ID: ENSP00000320309
MADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKKPFTPVKYFSIDRVFRNETLDATHLAEFHQIEGVVADHGLTLGHLMGVLREFFTKLGITQLRFKPAYNPYTEPSMEVFSYHQGLKKWVEVGNSGVFRPEMLLPMGLPENVSVIAWGLSLERPTMIKYGINNIRELVGHKVNLQMVYDSPLCRLDAEPRPPPTQEAA

SEQ ID NO: 62392 - protein, 477 aa, Homo sapiens
  Payload ID: 12466
  Gene Symbol: FARSA
  Gene Name: phenylalanyl-tRNA synthetase, alpha subunit
  Uniprot ID: Q9Y285
  ENSP ID: ENSP00000396548
MADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKKPFTPVKYFSIDRVFRNETLDATHLAEFHQIEGVVADHGLTLGHLMGVLREFFTKLGITQLRFKPAYNPYTEPSMEVFSYHQGLKKWVEVGNSGVFRPEMLLPMGLPENVSVIAWGLSLERPTMIKYGINNIRELVGHKVNLQMVYDSPLCRLDAEPRPPPTQEAA

SEQ ID NO: 62393 - protein, 168 aa, Homo sapiens
  Payload ID: 12466
  Gene Symbol: FARSA
  Gene Name: phenylalanyl-tRNA synthetase, alpha subunit
  ENSP ID: ENSP00000465402
MADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVRSCGLVRGQVDGHMGPWPSYPSHSLSWQVDSMEDEVQRR

SEQ ID NO: 62394 - protein, 378 aa, Homo sapiens
  Payload ID: 12466
  Gene Symbol: FARSA
  Gene Name: phenylalanyl-tRNA synthetase, alpha subunit
  ENSP ID: ENSP00000467384
  MOD_RES (1)..(1): Any amino acid
XAELLLRRLEASDGGLDSAELAAELGMEHQAVVGAVKSLQALGEVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKKPFTPVKYFSIDRVFRNETLDATHLAEFHQIEGVVADHGLTLGHLMGVLREFFTKLGITQLRFKPAYNPYTEPSMEVFSYHQGLKKWVEVGNSGVFRPEMLLPMGLPENVSVIAWGLSLE

SEQ ID NO: 62395 - protein, 548 aa, Homo sapiens
  Payload ID: 12466
  Gene Symbol: FARSA
  Gene Name: phenylalanyl-tRNA synthetase, alpha subunit
  ENSP ID: ENSP00000468051
MEPGWRWELSPMHLLRLRRHTQDDDTLSPVLQLDTFKMAVHTPVPVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKKPFTPVKYFSIDRVFRNETLDATHLAEFHQIEGVVADHGLTLGHLMGVLREFFTKLGITQLRFKPAYNPYTEPSMEVFSYHQGLKKWVEVGNSGVFRPEMLLPMGLPENVSVIAWGLSLERPTMIKYGINNIRELVGHKVNLQMVYDSPLCRLDAEPRPPPTQEAA

SEQ ID NO: 62396 - protein, 235 aa, Homo sapiens
  Payload ID: 12466
  Gene Symbol: FARSA
  Gene Name: phenylalanyl-tRNA synthetase, alpha subunit
  ENSP ID: ENSP00000468068
MADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVHRDAD

SEQ ID NO: 62397 - protein, 159 aa, Homo sapiens
  Payload ID: 12466
  Gene Symbol: FARSA
  Gene Name: phenylalanyl-tRNA synthetase, alpha subunit
  ENSP ID: ENSP00000468384
  MOD_RES (1)..(1): Any amino acid
XDNFIESSFWNFDALFQPQQHPARDQHDTFFLRDPAEALQLPMDYVQRVKRTHSQGGYGSQGYKYNWKLDEARKNLLRTHTTSASARALYRLAQKKPFTPVKYFSIDRVFRNETLDATHLAEFHQIEGVVADHGLTLGQPPPSSFPPVPGPESQGQRTG

SEQ ID NO: 62398 - protein, 589 aa, Homo sapiens
  Payload ID: 12467
  Gene Symbol: FARSB
  Gene Name: phenylalanyl-tRNA synthetase, beta subunit
  Uniprot ID: Q9NSD9
  ENSP ID: ENSP00000281828
MPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINVGPFL

SEQ ID NO: 62399 - protein, 282 aa, Homo sapiens
  Payload ID: 12468
  Gene Symbol: PNMT
  Gene Name: phenylethanolamine N-methyltransferase
  Uniprot ID: P11086
  ENSP ID: ENSP00000269582
MSGADRSPNAGAAPDSAPGQAAVASAYQRFEPRAYLRNNYAPPRGDLCNPNGVGPWKLRCLAQTFATGEVSGRTLIDIGSGPTVYQLLSACSHFEDITMTDFLEVNRQELGRWLQEEPGAFNWSMYSQHACLIEGKGECWQDKERQLRARVKRVLPIDVHQPQPLGAGSPAPLPADALVSAFCLEAVSPDLASFQRALDHITTLLRPGGHLLLIGALEESWYLAGEARLTVVPVSEEEVREALVRSGYKVRDLRTYIMPAHLQTGVDDVKGVFFAWAQKVGL

SEQ ID NO: 62400 - protein, 184 aa, Homo sapiens
  Payload ID: 12468
  Gene Symbol: PNMT
  Gene Name: phenylethanolamine N-methyltransferase
  ENSP ID: ENSP00000377791
MTDFLEVNRQELGRWLQEEPGAFNWSMYSQHACLIEGKGECWQDKERQLRARVKRVLPIDVHQPQPLGAGSPAPLPADALVSAFCLEAVSPDLASFQRALDHITTLLRPGGHLLLIGALEESWYLAGEARLTVVPVSEEEVREALVRSGYKVRDLRTYIMPAHLQTGVDDVKGVFFAWAQKVGL

SEQ ID NO: 62401 - protein, 137 aa, Homo sapiens
  Payload ID: 12468
  Gene Symbol: PNMT
  Gene Name: phenylethanolamine N-methyltransferase
  ENSP ID: ENSP00000464234
MSGADRSPNAGAAPDSAPGQAAVASAYQRFEPRAYLRNNYAPPRGDLCNPNGVGPWKLRCLAQTFATGEVSGRTLIDIGSGPTVYQLLSACSHFEDITMTDFLEVNRQELGRWLQEEPGAFNWSMYSQHACLIEGKG

SEQ ID NO: 62402 - protein, 136 aa, Homo sapiens
  Payload ID: 12469
  Gene Symbol: PMAIP1
  Gene Name: phorbol-12-myristate-13-acetate-induced protein 1
  Uniprot ID: Q13794
  ENSP ID: ENSP00000269518
MPGKKARKNAQPSPARAPAGPAGTAGTARDQAGFAIGMQLRFTRGKKLLSSSLSSSPLALPRGHEEQVQVAGSRVCYSTQEIWRQTELPAETSESDIQTLLLRNLTASKTCMRGLLQKSFLRRCTFHQFEERLHCN

SEQ ID NO: 62403 - protein, 54 aa, Homo sapiens
  Payload ID: 12469
  Gene Symbol: PMAIP1
  Gene Name: phorbol-12-myristate-13-acetate-induced protein 1
  Uniprot ID: Q13794
  ENSP ID: ENSP00000326119
MPGKKARKNAQPSPARAPAELEVECATQLRRFGDKLNFRQKLLNLISKLFCSGT

SEQ ID NO: 62404 - protein, 246 aa, Homo sapiens
  Payload ID: 12470
  Gene Symbol: PDC
  Gene Name: phosducin
  Uniprot ID: P20941
  ENSP ID: ENSP00000375855
MEEAKSQSLEEDFEGQATHTGPKGVINDWRKFKLESQDSDSIPPSKKEILRQMSSPQSRNGKDSKERVSRKMSIQEYELIHKEKEDENCLRKYRRQCMQDMHQKLSFGPRYGFVYELETGKQFLETIEKELKITTIVVHIYEDGIKGCDALNSSLTCLAAEYPIVKFCKIKASNTGAGDRFSLDVLPTLLIYKGGELISNFISVAEQFAEEFFAGDVESFLNEYGLLPEREVHVLEHTKIEEEDVE

SEQ ID NO: 62405 - protein, 194 aa, Homo sapiens
  Payload ID: 12470
  Gene Symbol: PDC
  Gene Name: phosducin
  Uniprot ID: P20941
  ENSP ID: ENSP00000422775
MSSPQSRNGKDSKERVSRKMSIQEYELIHKEKEDENCLRKYRRQCMQDMHQKLSFGPRYGFVYELETGKQFLETIEKELKITTIVVHIYEDGIKGCDALNSSLTCLAAEYPIVKFCKIKASNTGAGDRFSLDVLPTLLIYKGGELISNFISVAEQFAEEFFAGDVESFLNEYGLLPEREVHVLEHTKIEEEDVE

SEQ ID NO: 62406 - protein, 301 aa, Homo sapiens
  Payload ID: 12471
  Gene Symbol: PDCL
  Gene Name: phosducin-like
  Uniprot ID: Q13371
  ENSP ID: ENSP00000259467
MTTLDDKLLGEKLQYYYSSSEDEDSDHEDKDRGRCAPASSSVPAEAELAGEGISVNTGPKGVINDWRRFKQLETEQREEQCREMERLIKKLSMTCRSHLDEEEEQQKQKDLQEKISGKMTLKEFAIMNEDQDDEEFLQQYRKQRMEEMRQQLHKGPQFKQVFEISSGEGFLDMIDKEQKSIVIMVHIYEDGIPGTEAMNGCMICLAAEYPAVKFCKVKSSVIGASSQFTRNALPALLIYKGGELIGNFVRVTDQLGDDFFAVDLEAFLQEFGLLPEKEVLVLTSVRNSATCHSEDSDLEID

SEQ ID NO: 62407 - protein, 109 aa, Homo sapiens
  Payload ID: 12471
  Gene Symbol: PDCL
  Gene Name: phosducin-like
  ENSP ID: ENSP00000377826
  MOD_RES (1)..(1): Any amino acid
XLQYYYSSSEDEDSDHEDKDRGRCAPASSSVPAEAELAGEGISVNTGPKGVINDWRRFKQLETEQREEQCREMERLIKKLSMTCRSHLDEEEEQQKQKDLQEKISGKER

SEQ ID NO: 62408 - protein, 91 aa, Homo sapiens
  Payload ID: 12471
  Gene Symbol: PDCL
  Gene Name: phosducin-like
  ENSP ID: ENSP00000397984
  MOD_RES (1)..(1): Any amino acid
XCAPASSSVPAEAELAGEGISVNTGPKGVINDWRRFKQLETEQREEQCREMERLIKKLSMTCRSHLDEEEEQQKQKDLQEKISGKKSWAIL

SEQ ID NO: 62409 - protein, 241 aa, Homo sapiens
  Payload ID: 12472
  Gene Symbol: PDCL2
  Gene Name: phosducin-like 2
  Uniprot ID: Q8N4E4
  ENSP ID: ENSP00000295645
MQDPNEDTEWNDILRDFGILPPKEESKDEIEEMVLRLQKEAMVKPFEKMTLAQLKEAEDEFDEEDMQAVETYRKKRLQEWKALKKKQKFGELREISGNQYVNEVTNAEEDVWVIIHLYRSSIPMCLLVNQHLSLLARKFPETKFVKAIVNSCIQHYHDNCLPTIFVYKNGQIEAKFIGIIECGGINLKLEELEWKLAEVGAIQTDLEENPRKDMVDMMVSSIRNTSIHDDSDSSNSDNDTK

SEQ ID NO: 62410 - protein, 250 aa, Homo sapiens
  Payload ID: 12472
  Gene Symbol: PDCL2
  Gene Name: phosducin-like 2
  ENSP ID: ENSP00000480111
MQDPNEDTEWNDILRDFGILPPKEESKDEIEEMVLRLQKEAMVKPFEKMTLAQLKEAEDEFDEEDMQAVETYRKKRLQEWKALKKKQKFGELREISGNQYVNEVTNAEEDVWVIIHLYRSSIPMCLLVNQHLSLLARKFPETKFVKAIVNSCIQHYHDNCLPTIFVYKNGQIEAKFIGIIECGGINLKLEELEWKLAEVGAIQTDLEENPRKDMVDMMVSSIRNTSIHDDSDSSNSDNDPNREKYSINSF

SEQ ID NO: 62411 - protein, 239 aa, Homo sapiens
  Payload ID: 12473
  Gene Symbol: PDCL3
  Gene Name: phosducin-like 3
  Uniprot ID: Q9H2J4
  ENSP ID: ENSP00000264254
MQDPNADTEWNDILRKKGILPPKESLKELEEEAEEEQRILQQSVVKTYEDMTLEELEDHEDEFNEEDERAIEMYRRRRLAEWKATKLKNKFGEVLEISGKDYVQEVTKAGEGLWVILHLYKQGIPLCALINQHLSGLARKFPDVKFIKAISTTCIPNYPDRNLPTIFVYLEGDIKAQFIGPLVFGGMNLTRDELEWKLSESGAIMTDLEENPKKPIEDVLLSSVRRSVLMKRDSDSEGD

SEQ ID NO: 62412 - protein, 150 aa, Homo sapiens
  Payload ID: 12473
  Gene Symbol: PDCL3
  Gene Name: phosducin-like 3
  ENSP ID: ENSP00000390585
  MOD_RES (1)..(1): Any amino acid
XEELEDHEDEFNEEDERAIEMYRRRRLAEWKATKLKNKFGEVLEISGKDYVQEVTKAGEGLWVILHLYKQGIPLCALINQHLSGLARKFPDVKFIKAISTTCIPNYPDRNLPTIFVYLEGDIKAQFIGPLVFGGMNLTRDGKGSGRQAGQ

SEQ ID NO: 62413 - protein, 87 aa, Homo sapiens
  Payload ID: 12473
  Gene Symbol: PDCL3
  Gene Name: phosducin-like 3
  ENSP ID: ENSP00000413936
MTLEELEDHEDEFNEEDERAIEMYRRRRLAEWKATKLKNKFGEVLEISGKDYVQEVTKAGEGLWVILHLYKQGIPLCALINQHLSGL

SEQ ID NO: 62414 - protein, 580 aa, Homo sapiens; identical to SEQ ID NO: 62216
  Payload ID: 12474
  Gene Symbol: PHACTR1
  Gene Name: phosphatase and actin regulator 1
  Uniprot ID: Q9C0D0
  ENSP ID: ENSP00000329880

SEQ ID NO: 62415 - protein, 140 aa, Homo sapiens; identical to SEQ ID NO: 62214
  Payload ID: 12474
  Gene Symbol: PHACTR1
  Gene Name: phosphatase and actin regulator 1
  ENSP ID: ENSP00000368633

SEQ ID NO: 62416 - protein, 144 aa, Homo sapiens; identical to SEQ ID NO: 62211
  Payload ID: 12474
  Gene Symbol: PHACTR1
  Gene Name: phosphatase and actin regulator 1
  ENSP ID: ENSP00000368639

SEQ ID NO: 62417 - protein, 169 aa, Homo sapiens; identical to SEQ ID NO: 62217
  Payload ID: 12474
  Gene Symbol: PHACTR1
  Gene Name: phosphatase and actin regulator 1
  ENSP ID: ENSP00000368653

SEQ ID NO: 62418 - protein, 484 aa, Homo sapiens; identical to SEQ ID NO: 62213
  Payload ID: 12474
  Gene Symbol: PHACTR1
  Gene Name: phosphatase and actin regulator 1
  Uniprot ID: Q9C0D0
  ENSP ID: ENSP00000368655

SEQ ID NO: 62419 - protein, 264 aa, Homo sapiens; identical to SEQ ID NO: 62212
  Payload ID: 12474
  Gene Symbol: PHACTR1
  Gene Name: phosphatase and actin regulator 1
  ENSP ID: ENSP00000384760
  MOD_RES (1)..(1): Any amino acid

SEQ ID NO: 62420 - protein, 488 aa, Homo sapiens; identical to SEQ ID NO: 62215
  Payload ID: 12474
  Gene Symbol: PHACTR1
  Gene Name: phosphatase and actin regulator 1
  ENSP ID: ENSP00000395948

SEQ ID NO: 62421 - protein, 230 aa, Homo sapiens; identical to SEQ ID NO: 62210
  Payload ID: 12474
  Gene Symbol: PHACTR1
  Gene Name: phosphatase and actin regulator 1
  ENSP ID: ENSP00000412573

SEQ ID NO: 62422 - protein, 554 aa, Homo sapiens
  Payload ID: 12475
  Gene Symbol: PHACTR2
  Gene Name: phosphatase and actin regulator 2
  Uniprot ID: O75167
  ENSP ID: ENSP00000305530
MDNAVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 62423 - protein, 565 aa, Homo sapiens
  Payload ID: 12475
  Gene Symbol: PHACTR2
  Gene Name: phosphatase and actin regulator 2
  Uniprot ID: O75167
  ENSP ID: ENSP00000356554
MGQTSVSTLSPQPGSVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 62424 - protein, 622 aa, Homo sapiens
  Payload ID: 12475
  Gene Symbol: PHACTR2
  Gene Name: phosphatase and actin regulator 2
  ENSP ID: ENSP00000356556
MAEAGWRPAASPVDPAGQAAAVPVPEPEAPAPPAAPALRWLPGDPSPRGRSQSDLSSSSSRGRPLRVHISGSVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 62425 - protein, 153 aa, Homo sapiens
  Payload ID: 12475
  Gene Symbol: PHACTR2
  Gene Name: phosphatase and actin regulator 2
  ENSP ID: ENSP00000381067
MGQTSVSTLSPQPGSVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKDC

SEQ ID NO: 62426 - protein, 634 aa, Homo sapiens
  Payload ID: 12475
  Gene Symbol: PHACTR2
  Gene Name: phosphatase and actin regulator 2
  Uniprot ID: O75167
  ENSP ID: ENSP00000391763
MDNAVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKENTENHSETPAAPALPPSAPPKPRPKPKPKKSPVPPKGATAGASHKGDEVPPIKKNTKAPGKQAPVPPPKPASRNTTREAAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 62427 - protein, 178 aa, Homo sapiens
  Payload ID: 12475
  Gene Symbol: PHACTR2
  Gene Name: phosphatase and actin regulator 2
  ENSP ID: ENSP00000402449
MGQTSVSTLSPQPGSVDGLDKASIANSDGPTAGSQTPPFKRKGKLSTIGKIFKPWKWRKKKTSDKFRETSAVLERKISTRQSREELIRRGVLKELPDQAGSSHSKKTTGSKASASPSTSSTSSRPKASKETVSSKAGTVGTTKGKRKTDKQPITSHLSSDTTTSGTSDLKGEPAETRV

SEQ ID NO: 62428 - protein, 645 aa, Homo sapiens
  Payload ID: 12475
  Gene Symbol: PHACTR2
  Gene Name: phosphatase and actin regulator 2
  Uniprot ID: O75167
  ENSP ID: ENSP00000417038
MGQTSVSTLSPQPGSVDGLDKASIANSDGPTAGSQTPPFKRKGKLSTIGKIFKPWKWRKKKTSDKFRETSAVLERKISTRQSREELIRRGVLKELPDQDGDVTVNFENSNGHMIPIGEESTREENVVKSEEGNGSVSEKTPPLEEQAEDKKENTENHSETPAAPALPPSAPPKPRPKPKPKKSPVPPKGATAGASHKGDEVPPIKKNTKAPGKQAPVPPPKPASRNTTREAAGSSHSKKTTGSKASASPSTSSTSSRPKASKETVSSKAGTVGTTKGKRKTDKQPITSHLSSDTTTSGTSDLKGEPAETRVESFKLEQTVPGAEEQNTGKFKSMVPPPPVAPAPSPLAPPLPLEDQCITASDTPVVLVSVGADLPVSALDPSQLLWAEEPTNRTTLYSGTGLSVNRENAKCFTTKEELGKTVPQLLTPGLMGESSESFSASEDEGHREYQANDSDSDGPILYTDDEDEDEDEDGSGESALASKIRRRDTLAIKLGNRPSKKELEDKNILQRTSEEERQEIRQQIGTKLVRRLSQRPTTEELEQRNILKQKNEEEEQEAKMELKRRLSRKLSLRPTVAELQARRILRFNEYVEVTDSPDYDRRADKPWARLTPADKAAIRKELNEFKSTEMEVHEESRQFTRFHRP

SEQ ID NO: 62429 - protein, 166 aa, Homo sapiens
  Payload ID: 12475
  Gene Symbol: PHACTR2
  Gene Name: phosphatase and actin regulator 2
  ENSP ID: ENSP00000442153
MGQTSVSTLSPQPGSVLERKISTRQSREELIRRGVLKELPDQDGDVTVNFENSNGHMIPIGEESTREENVVKSEEGNGSVSEKTPPLEEQAEDKKAGSSHSKKTTGSKASASPSTSSTSSRPKASKETVSSKAGTVGTTKGKRKTDKQPITSHLSSDTTTSGTSDL

SEQ ID NO: 62430 - protein, 518 aa, Homo sapiens
  Payload ID: 12476
  Gene Symbol: PHACTR3
  Gene Name: phosphatase and actin regulator 3
  Uniprot ID: Q96KR7
  ENSP ID: ENSP00000347866
MDQTPPARPEYLVSGIRTPPVRRNSKLATLGRIFKPWKWRKKKNEKLKQTTSALEKKMAGRQGREELIKKGLLEMMEQDAESKTCNPDGGPRSVQSEPPTPKSETLTSEDAQPGSPLATGTDQVSLDKPLSSAAHLDDAAKMPSASSGEEADAGSLLPTTNELSQALAGADSLDSPPRPLERSVGQLPSPPLLPTPPPKASSKTTKNVTGQATLFQASSMKSADPSLRGQLSTPTGSPHLTTVHRPLPPSRVIEELHRALATKHRQDSFQGRESKGSPKKRLDVRLSRTSSVERGKEREEAWSFDGALENKRTAAKESEENKENLIINSELKDDLLLYQDEEALNDSIISGTLPRKCKKELLAVKLRNRPSKQELEDRNIFPRRTDEERQEIRQQIEMKLSKRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTRFHRP

SEQ ID NO: 62431 - protein, 556 aa, Homo sapiens
  Payload ID: 12476
  Gene Symbol: PHACTR3
  Gene Name: phosphatase and actin regulator 3
  Uniprot ID: Q96KR7
  ENSP ID: ENSP00000353002
MRGRGGGRARCPAPLRSLLGAFGARDAAAAARDPAQDEMDQTPPARPEYLVSGIRTPPVRRNSKLATLGRIFKPWKWRKKKNEKLKQTTSALEKKMAGRQGREELIKKGLLEMMEQDAESKTCNPDGGPRSVQSEPPTPKSETLTSEDAQPGSPLATGTDQVSLDKPLSSAAHLDDAAKMPSASSGEEADAGSLLPTTNELSQALAGADSLDSPPRPLERSVGQLPSPPLLPTPPPKASSKTTKNVTGQATLFQASSMKSADPSLRGQLSTPTGSPHLTTVHRPLPPSRVIEELHRALATKHRQDSFQGRESKGSPKKRLDVRLSRTSSVERGKEREEAWSFDGALENKRTAAKESEENKENLIINSELKDDLLLYQDEEALNDSIISGTLPRKCKKELLAVKLRNRPSKQELEDRNIFPRRTDEERQEIRQQIEMKLSKRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTRFHRP

SEQ ID NO: 62432 - protein, 448 aa, Homo sapiens
  Payload ID: 12476
  Gene Symbol: PHACTR3
  Gene Name: phosphatase and actin regulator 3
  Uniprot ID: Q96KR7
  ENSP ID: ENSP00000354555
MDQTPPARPEYLVSGIRTPPVRRNSKLATLGRIFKPWKWRKKKNEKLKQTTSALEKKMAGRQGREELIKKGLLEMMEQDAESKTCNPDGGPRSVQSEPPTPKSETLTSEDAQPGSPLATGTDQVSLDKPLSSAAHLDDAGQATLFQASSMKSADPSLRGQLSTPTGSPHLTTVHRPLPPSRVIEELHRALATKHRQDSFQGRESKGSPKKRLDVRLSRTSSVERGKEREEAWSFDGALENKRTAAKESEENKENLIINSELKDDLLLYQDEEALNDSIISGTLPRKCKKELLAVKLRNRPSKQELEDRNIFPRRTDEERQEIRQQIEMKLSKRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTRFHRP

SEQ ID NO: 62433 - protein, 559 aa, Homo sapiens
  Payload ID: 12476
  Gene Symbol: PHACTR3
  Gene Name: phosphatase and actin regulator 3
  Uniprot ID: Q96KR7
  ENSP ID: ENSP00000360054
MAASEDGSGCLVSRGRSQSDPSVLTDSSATSSADAGENPDEMDQTPPARPEYLVSGIRTPPVRRNSKLATLGRIFKPWKWRKKKNEKLKQTTSALEKKMAGRQGREELIKKGLLEMMEQDAESKTCNPDGGPRSVQSEPPTPKSETLTSEDAQPGSPLATGTDQVSLDKPLSSAAHLDDAAKMPSASSGEEADAGSLLPTTNELSQALAGADSLDSPPRPLERSVGQLPSPPLLPTPPPKASSKTTKNVTGQATLFQASSMKSADPSLRGQLSTPTGSPHLTTVHRPLPPSRVIEELHRALATKHRQDSFQGRESKGSPKKRLDVRLSRTSSVERGKEREEAWSFDGALENKRTAAKESEENKENLIINSELKDDLLLYQDEEALNDSIISGTLPRKCKKELLAVKLRNRPSKQELEDRNIFPRRTDEERQEIRQQIEMKLSKRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTRFHRP

SEQ ID NO: 62434 - protein, 518 aa, Homo sapiens; identical to SEQ ID NO: 62430
  Payload ID: 12476
  Gene Symbol: PHACTR3
  Gene Name: phosphatase and actin regulator 3
  Uniprot ID: Q96KR7
  ENSP ID: ENSP00000378998

SEQ ID NO: 62435 - protein, 41 aa, Homo sapiens
  Payload ID: 12476
  Gene Symbol: PHACTR3
  Gene Name: phosphatase and actin regulator 3
  ENSP ID: ENSP00000390915
MAASEDGSGCLVSRGRSQSDPSVLTDSSATSSADAGENPDE

SEQ ID NO: 62436 - protein, 518 aa, Homo sapiens; identical to SEQ ID NO: 62430
  Payload ID: 12476
  Gene Symbol: PHACTR3
  Gene Name: phosphatase and actin regulator 3
  Uniprot ID: Q96KR7
  ENSP ID: ENSP00000442483

SEQ ID NO: 62437 - protein, 712 aa, Homo sapiens
  Payload ID: 12477
  Gene Symbol: PHACTR4
  Gene Name: phosphatase and actin regulator 4
  Uniprot ID: Q8IZ21
  ENSP ID: ENSP00000362942
MGQADVSRPVNPDAVEEADQPTTEPGMVLDSVEAGDTTPPTKRKSKFSGFGKIFKPWKWRKKKSSDKFKETSEVLERKISMRKPREELVKRGVLLEDPEQGGEDPGKPSDAMLKNGHTTPIGNARSSSPVQVEEEPVRLASLRKAIPEEDLKKRLGSTGSQPNSEAESVPENVPKPPLLPPKRPLSSSHEASEGQAKDATSSGGTARFIISTSITTAPAATTAATSLAKTVNLSVTPSPAPRTLPAAPASTNTTATPSLTHMVPAKQPPIPPPKPAHRNSNPVIAELSQAINSGTLLSKPSPPLPPKRGIPSTSVPTLESAAAITTKTPSDEREKSTCSMGSELLPMISPRSPSPPLPTHIPPEPPRTPPFPAKTFQVVPEIEFPPSLDLHQEIPQQEDQKKEVPKRILDQNFGEPHIPSRLPPLPLHIRIQQALTSPLPMTPILEGSHRAHSLLFENSDSFSEDSSTLGRTRSLPITIEMLKVPDDEEEEEQTCPSTFSEEMTPTSVIPKLPQCLREEEEKESDSDSEGPIQYRDEEDEDESYQSALANKVKRKDTLAMKLNHRPSEPELNLNSWPCKSKEEWNEIRHQIGNTLIRRLSQRPTPEELEQRNILQPKNEADRQAEKREIKRRLTRKLSQRPTVAELLARKILRFNEYVEVTDAQDYDRRADKPWTKLTPADKAAIRKELNEFKSSEMEVHEESKHFTRYHRP

SEQ ID NO: 62438 - protein, 702 aa, Homo sapiens
  Payload ID: 12477
  Gene Symbol: PHACTR4
  Gene Name: phosphatase and actin regulator 4
  Uniprot ID: Q8IZ21
  ENSP ID: ENSP00000362945
MEDPFEEADQPTTEPGMVLDSVEAGDTTPPTKRKSKFSGFGKIFKPWKWRKKKSSDKFKETSEVLERKISMRKPREELVKRGVLLEDPEQGGEDPGKPSDAMLKNGHTTPIGNARSSSPVQVEEEPVRLASLRKAIPEEDLKKRLGSTGSQPNSEAESVPENVPKPPLLPPKRPLSSSHEASEGQAKDATSSGGTARFIISTSITTAPAATTAATSLAKTVNLSVTPSPAPRTLPAAPASTNTTATPSLTHMVPAKQPPIPPPKPAHRNSNPVIAELSQAINSGTLLSKPSPPLPPKRGIPSTSVPTLESAAAITTKTPSDEREKSTCSMGSELLPMISPRSPSPPLPTHIPPEPPRTPPFPAKTFQVVPEIEFPPSLDLHQEIPQQEDQKKEVPKRILDQNFGEPHIPSRLPPLPLHIRIQQALTSPLPMTPILEGSHRAHSLLFENSDSFSEDSSTLGRTRSLPITIEMLKVPDDEEEEEQTCPSTFSEEMTPTSVIPKLPQCLREEEEKESDSDSEGPIQYRDEEDEDESYQSALANKVKRKDTLAMKLNHRPSEPELNLNSWPCKSKEEWNEIRHQIGNTLIRRLSQRPTPEELEQRNILQPKNEADRQAEKREIKRRLTRKLSQRPTVAELLARKILRFNEYVEVTDAQDYDRRADKPWTKLTPADKAAIRKELNEFKSSEMEVHEESKHFTRYHRP

SEQ ID NO: 62439 - protein, 221 aa, Homo sapiens
  Payload ID: 12477
  Gene Symbol: PHACTR4
  Gene Name: phosphatase and actin regulator 4
  ENSP ID: ENSP00000487630
MEDPFDFSREPWNKEADQPTTEPGMVLDSVEAGDTTPPTKRKSKFSGFGKIFKPWKWRKKKSSDKFKETSEVLERKISMRKPREELVKRGVLLEDPEQGGEDPGKPSDAMLKNGHTTPIGNARSSSPVQVEEEPVRLASLRKAIPEEDLKKRLGSTGSQPNSEAESVPENVPKPPLLPPKRPLSSSHEASEGQAKDATSSGGTARFIISTSITTAPAATTA

SEQ ID NO: 62440 - protein, 106 aa, Homo sapiens
  Payload ID: 12477
  Gene Symbol: PHACTR4
  Gene Name: phosphatase and actin regulator 4
  ENSP ID: ENSP00000488137
MGQADVSRPVNPDAVDFSREPWNKEADQPTTEPGMVLDSVEAGDTTPPTKRKSKFSGFGKIFKPWKWRKKKSSDKFKETSEVLERKISMRKPREELVKRGVLLEDP

SEQ ID NO: 62441 - protein, 63 aa, Homo sapiens
  Payload ID: 12477
  Gene Symbol: PHACTR4
  Gene Name: phosphatase and actin regulator 4
  Uniprot ID: Q8IZ21
  ENSP ID: ENSP00000488359
MEDPFDFSREPWNSRGSRPAHYRARHGPGQCGSRRHNTSYQKEEQVLRLWQDLQALEMEEKKK

SEQ ID NO: 62442 - protein, 41 aa, Homo sapiens
  Payload ID: 12477
  Gene Symbol: PHACTR4
  Gene Name: phosphatase and actin regulator 4
  ENSP ID: ENSP00000488693
MEDPFEMGFYHVTQAGLELLDSSNPRLASQSAGIRGVSHCT

SEQ ID NO: 62443 - protein, 403 aa, Homo sapiens [sequence omitted]

SEQ ID NO: 62444 - protein, 156 aa, Homo sapiens
  Payload ID: 12478
  Gene Symbol: PTEN
  Gene Name: phosphatase and tensin homolog
  ENSP ID: ENSP00000477517
MGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKADPTGGIPDKGIIVIGDGSSMDVIAP

SEQ ID NO: 62445 - protein, 153 aa, Homo sapiens
  Payload ID: 12478
  Gene Symbol: PTEN
  Gene Name: phosphatase and tensin homolog
  ENSP ID: ENSP00000483066
ALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVS

SEQ ID NO: 62446 - protein, 856 aa, Homo sapiens
  Payload ID: 12479
  Gene Symbol: PALD1
  Gene Name: phosphatase domain containing, paladin 1
  Uniprot ID: Q9ULE6
  ENSP ID: ENSP00000263563
MGTTASTAQQTVSAGTPFEGLQGSGTMDSRHSVSIHSFQSTSLHNSKAKSIIPNKVAPVVITYNCKEEFQIHDELLKAHYTLGRLSDNTPEHYLVQGRYFLVRDVTEKMDVLGTVGSCGAPNFRQVQGGLTVFGMGQPSLSGFRRVLQKLQKDGHRECVIFCVREEPVLFLRADEDFVSYTPRDKQNLHENLQGLGPGVRVESLELAIRKEIHDFAQLSENTYHVYHNTEDLWGEPHAVAIHGEDDLHVTEEVYKRPLFLQPTYRYHRLPLPEQGSPLEAQLDAFVSVLRETPSLLQLRDAHGPPPALVFSCQMGVGRTNLGMVLGTLILLHRSGTTSQPEAAPTQAKPLPMEQFQVIQSFLRMVPQGRRMVEEVDRAITACAELHDLKEVVLENQKKLEGIRPESPAQGSGSRHSVWQRALWSLERYFYLILFNYYLHEQYPLAFALSFSRWLCAHPELYRLPVTLSSAGPVAPRDLIARGSLREDDLVSPDALSTVREMDVANFRRVPRMPIYGTAQPSAKALGSILAYLTDAKRRLRKVVWVSLREEAVLECDGHTYSLRWPGPPVAPDQLETLEAQLKAHLSEPPPGKEGPLTYRFQTCLTMQEVFSQHRRACPGLTYHRIPMPDFCAPREEDFDQLLEALRAALSKDPGTGFVFSCLSGQGRTTTAMVVAVLAFWHIQGFPEVGEEELVSVPDAKFTKGEFQVVMKVVQLLPDGHRVKKEVDAALDTVSETMTPMHYHLREIIICTYRQAKAAKEAQEMRRLQLRSLQYLERYVCLILFNAYLHLEKADSWQRPFSTWMQEVASKAGIYEILNELGFPELESGEDQPFSRLRYRWQEQSCSLEPSAPEDLL

SEQ ID NO: 62447 - protein, 267 aa, Homo sapiens
  Payload ID: 12480
  Gene Symbol: PHOSPHO1
  Gene Name: phosphatase, orphan 1
  Uniprot ID: Q8TCT1
  ENSP ID: ENSP00000311925
MSGCFPVSGLRCLSRDGRMAAQGAPRFLLTFDFDETIVDENSDDSIVRAAPGQRLPESLRATYREGFYNEYMQRVFKYLGEQGVRPRDLSAIYEAIPLSPGMSDLLQFVAKQGACFEVILISDANTFGVESSLRAAGHHSLFRRILSNPSGPDARGLLALRPFHTHSCARCPANMCKHKVLSDYLRERAHDGVHFERLFYVGDGANDFCPMGLLAGGDVAFPRRGYPMHRLIQEAQKAEPSSFRASVVPWETAADVRLHLQQVLKSC

SEQ ID NO: 62448 - protein, 292 aa, Homo sapiens
  Payload ID: 12480
  Gene Symbol: PHOSPHO1
  Gene Name: phosphatase, orphan 1
  Uniprot ID: Q8TCT1
  ENSP ID: ENSP00000406909
MCQRLWPWPANQPLPGGLLPRPLSLAPSSSSSCCSPPCSQDGRMAAQGAPRFLLTFDFDETIVDENSDDSIVRAAPGQRLPESLRATYREGFYNEYMQRVFKYLGEQGVRPRDLSAIYEAIPLSPGMSDLLQFVAKQGACFEVILISDANTFGVESSLRAAGHHSLFRRILSNPSGPDARGLLALRPFHTHSCARCPANMCKHKVLSDYLRERAHDGVHFERLFYVGDGANDFCPMGLLAGGDVAFPRRGYPMHRLIQEAQKAEPSSFRASVVPWETAADVRLHLQQVLKSC

SEQ ID NO: 62449 - protein, 166 aa, Homo sapiens
  Payload ID: 12480
  Gene Symbol: PHOSPHO1
  Gene Name: phosphatase, orphan 1
  ENSP ID: ENSP00000424406
MSGCFPVSGLRCLSRVCHGLVREALTSPSPTASPAARLLRTLAETPPADTFLLGNWCWMCQRLWPWPANQPLPGGLLPRPLSLAPSSSSSCCSPPCSQDGRMAAQGAPRFLLTFDFDETIVDENSDDSIVRAAPGQRLPESLRATYREGFYNEYMQRVFKYLGEQG

SEQ ID NO: 62450 - protein, 203 aa, Homo sapiens
  Payload ID: 12480
  Gene Symbol: PHOSPHO1
  Gene Name: phosphatase, orphan 1
  ENSP ID: ENSP00000426095
MSGCFPVSGLRCLSRDGRMAAQGAPRFLLTFDFDETIVDENSDDSIVRAAPGQRLPESLRATYREGFYNEYMQRVFKYLGEQGVRPRDLSAIYEAIPLSPGMSDLLQFVAKQGACFEVILISDANTFGVESSLRAAGHHSLFRRILSNPSGPDARGLLALRPFHTHSCARCPANMCKHKVLSDYLRERAHDGVHFERLFYVGD

SEQ ID NO: 62451 - protein, 111 aa, Homo sapiens
  Payload ID: 12480
  Gene Symbol: PHOSPHO1
  Gene Name: phosphatase, orphan 1
  ENSP ID: ENSP00000427397
MCQRLWPWPANQPLPGGLLPRPLSLAPSSSSSCCSPPCSQDGRMAAQGAPRFLLTFDFDETIVDENSDDSIVRAAPGQRLPESLRATYREGFYNEYMQRVFKYLGEQGVRP

SEQ ID NO: 62452 - protein, 292 aa, Homo sapiens; identical to SEQ ID NO: 62448
  Payload ID: 12480
  Gene Symbol: PHOSPHO1
  Gene Name: phosphatase, orphan 1
  Uniprot ID: Q8TCT1
  ENSP ID: ENSP00000427694

SEQ ID NO: 62453 - protein, 86 aa, Homo sapiens
  Payload ID: 12480
  Gene Symbol: PHOSPHO1
  Gene Name: phosphatase, orphan 1
  ENSP ID: ENSP00000461392
MSGCFPVSGLRCLSRDGRMAAQGAPRFLLTFDFDETIVDENSDDSIVRAAPGQRLPESLRATYREGFYNEYMQRVFKYLGEQGVRP

SEQ ID NO: 62454 - protein, 241 aa, Homo sapiens
  Payload ID: 12481
  Gene Symbol: PHOSPHO2
  Gene Name: phosphatase, orphan 2
  Uniprot ID: Q8TCD6
  ENSP ID: ENSP00000352782
MKILLVFDFDNTIIDDNSDTWIVQCAPNKKLPIELRDSYRKGFWTEFMGRVFKYLGDKGVREHEMKRAVTSLPFTPGMVELFNFIRKNKDKFDCIIISDSNSVFIDWVLEAASFHDIFDKVFTNPAAFNSNGHLTVENYHTHSCNRCPKNLCKKVVLIEFVDKQLQQGVNYTQIVYIGDGGNDVCPVTFLKNDDVAMPRKGYTLQKTLSRMSQNLEPMEYSVVVWSSGVDIISHLQFLIKD

SEQ ID NO: 62455 - protein, 55 aa, Homo sapiens
  Payload ID: 12481
  Gene Symbol: PHOSPHO2
  Gene Name: phosphatase, orphan 2
  ENSP ID: ENSP00000393983
MKILLVFDFDNTIIDDNSDTWIVQCAPNKKLPIELRDSYRKGFWTEFMGRVFKYL

SEQ ID NO: 62456 - protein, 135 aa, Homo sapiens
  Payload ID: 12481
  Gene Symbol: PHOSPHO2
  Gene Name: phosphatase, orphan 2
  ENSP ID: ENSP00000411844
MKILLVFDFDNTIIDDNSDTWIVQCAPNKKLPIELRDSYRKGFWTEFMGRVFKYLGDKGVREHEMKRAVTSLPFTPGMVELFNFIRKNKDKFDCIIISDSNSVFIDWVLEAASFHDIFDKVFTNPAAFNSNGHLT

SEQ ID NO: 62457 - protein, 49 aa, Homo sapiens
  Payload ID: 12481
  Gene Symbol: PHOSPHO2
  Gene Name: phosphatase, orphan 2
  ENSP ID: ENSP00000416790
MKILLVFDFDNTIIDDNSDTWIVQCAPNKKLPIELRDSYRKGFWTEFMG

SEQ ID NO: 62458 - protein, 241 aa, Homo sapiens; identical to SEQ ID NO: 62454
  Payload ID: 12481
  Gene Symbol: PHOSPHO2
  Gene Name: phosphatase, orphan 2
  Uniprot ID: Q8TCD6
  ENSP ID: ENSP00000481046

SEQ ID NO: 62459 - protein, 241 aa, Homo sapiens; identical to SEQ ID NO: 62454
  Payload ID: 12481
  Gene Symbol: PHOSPHO2
  Gene Name: phosphatase, orphan 2
  Uniprot ID: Q8TCD6
  ENSP ID: ENSP00000481680

SEQ ID NO: 62460 - protein, 241 aa, Homo sapiens; identical to SEQ ID NO: 62454
  Payload ID: 12481
  Gene Symbol: PHOSPHO2
  Gene Name: phosphatase, orphan 2
  Uniprot ID: Q8TCD6
  ENSP ID: ENSP00000481857

SEQ ID NO: 62461 - protein, 367 aa, Homo sapiens
  Payload ID: 12482
  Gene Symbol: PCYT1A
  Gene Name: phosphate cytidylyltransferase 1, choline, alpha
  Uniprot ID: P49585
  ENSP ID: ENSP00000292823
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQAKNLFPNTYLIVGVCSDELTHNFKGFTVMNENERYDAVQHCRYVDEVVRNAPWTLTPEFLAEHRIDFVAHDDIPYSSAGSDDVYKHIKEAGMFAPTQRTEGISTSDIITRIVRDYDVYARRNLQRGYTAKELNVSFINEKKYHLQERVDKVKKKVKDVEEKSKEFVQKVEEKSIDLIQKWEEKSREFIGSFLEMFGPEGALKHMLKEGKGRMLQAISPKQSPSSSPTRERSPSPSFRWPFSGKTSPPCSPANLSRHKAAAYDISEDEED

SEQ ID NO: 62462 - protein, 137 aa, Homo sapiens
  Payload ID: 12482
  Gene Symbol: PCYT1A
  Gene Name: phosphate cytidylyltransferase 1, choline, alpha
  ENSP ID: ENSP00000390458
NENERYDAVQHCRYVDEVVRNAPWTLTPEFLAEHRIDFVAHDDIPYSSAGSDDVYKHIKEAGMFAPTQRTEGISTSDIITRIVRDYDVYARRNLQRGYTAKELNVSFINAMSPPRVDSDTRHTTSHTDLSFKFGLTK

SEQ ID NO: 62463 - protein, 380 aa, Homo sapiens
  Payload ID: 12482
  Gene Symbol: PCYT1A
  Gene Name: phosphate cytidylyltransferase 1, choline, alpha
  ENSP ID: ENSP00000390968
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQAKNLFPNTYLIVGVCSDELTHNFKGFTVMNENERYDAVQHCRYVDEVVRNAPWTLTPEFLAEHRIDFVAHDDIPYSSAGSDDVYKHIKEAGMFAPTQRTEGISTSDIITRIVRDYDVYARRNLQRGYTAKELNVSFINEKKYHLQERVDKVKKKVKDVEEKSKEFVQKVEEKSIDLIQKWEEKSREFIGSFLEMFGPEGALKHMLKEGKGRMLQAISPKQSPSSSPTRERSPSPSFRWPFSGKTSPPCSPANLSRHKAAAYDIRYSYLEQSKFGSHVLLTQV

SEQ ID NO: 62464 - protein, 90 aa, Homo sapiens
  Payload ID: 12482
  Gene Symbol: PCYT1A
  Gene Name: phosphate cytidylyltransferase 1, choline, alpha
  ENSP ID: ENSP00000391405
MDAQCSAKVNARKRRKEAPGPNGATEEDGVPSKVQRCAVSLQPLEATNLLSDSVDLPVLDIHTNDIIRAYGNQLLFLMKLKLTLVSPMSG

SEQ ID NO: 62465 - protein, 212 aa, Homo sapiens
  Payload ID: 12482
  Gene Symbol: PCYT1A
  Gene Name: phosphate cytidylyltransferase 1, choline, alpha
  ENSP ID: ENSP00000392397
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQAKNLFPNTYLIVGVCSDELTHNFKGFTVMNENERYDAVQHCRYVDEVVRNAPWTLTPEFLAEHRGMNSIAFVCRKPEARPLFTLGLITRPRPLPRRGSSHLESQHFGRPKRTDH

SEQ ID NO: 62466 - protein, 115 aa, Homo sapiens
  Payload ID: 12482
  Gene Symbol: PCYT1A
  Gene Name: phosphate cytidylyltransferase 1, choline, alpha
  ENSP ID: ENSP00000393341
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQAKNLFPNTYLIVGVCSD

SEQ ID NO: 62467 - protein, 367 aa, Homo sapiens; identical to SEQ ID NO: 62461
  Payload ID: 12482
  Gene Symbol: PCYT1A
  Gene Name: phosphate cytidylyltransferase 1, choline, alpha
  Uniprot ID: P49585
  ENSP ID: ENSP00000394617

SEQ ID NO: 62468 - protein, 134 aa, Homo sapiens
  Payload ID: 12482
  Gene Symbol: PCYT1A
  Gene Name: phosphate cytidylyltransferase 1, choline, alpha
  ENSP ID: ENSP00000397888
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQAKNLFPNTYLIVGDFFPVGEDGCSPKQWEKMGEVGG

SEQ ID NO: 62469 - protein, 293 aa, Homo sapiens
  Payload ID: 12482
  Gene Symbol: PCYT1A
  Gene Name: phosphate cytidylyltransferase 1, choline, alpha
  ENSP ID: ENSP00000400430
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQAKNLFPNTYLIVGVCSDELTHNFKGFTVMNENERYDAVQHCRYVDEVVRNAPWTLTPEFLAEHRIDFVAHDDIPYSSAGSDDVYKHIKEAGMFAPTQRTEGISTSDIITRIVRDYDVYARRNLQRGYTAKELNVSFINEKKYHLQERVDKVKKKVKDVEEKSKEFVQKVEEKSIDLIQKWEEKSREFIGSFLEMF

SEQ ID NO: 62470 - protein, 133 aa, Homo sapiens
  Payload ID: 12482
  Gene Symbol: PCYT1A
  Gene Name: phosphate cytidylyltransferase 1, choline, alpha
  ENSP ID: ENSP00000402015
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQAKNLFPNTYLIVGVCSDELTHNFKGFTVMNENERY

SEQ ID NO: 62471 - protein, 201 aa, Homo sapiens
  Payload ID: 12482
  Gene Symbol: PCYT1A
  Gene Name: phosphate cytidylyltransferase 1, choline, alpha
  ENSP ID: ENSP00000402283
ASRGTPCERPVRVYADGIFDLFHSGHARALMQAKNLFPNTYLIVGVCSDELTHNFKGFTVMNENERYDAVQHCRYVDEVVRNAPWTLTPEFLAEHRIDFVAHDDIPYSSAGSDDVYKHIKEAGMFAPTQRTEGISTSDIITRIVRDYDVYARRNLQRGYTAKELNVSFINVSSSLTPEFPDSVGDISPPTPSQLNWLCSWL

SEQ ID NO: 62472 - protein, 330 aa, Homo sapiens
  Payload ID: 12483
  Gene Symbol: PCYT1B
  Gene Name: phosphate cytidylyltransferase 1, choline, beta
  Uniprot ID: Q9Y5K3
  ENSP ID: ENSP00000349211
MPVVTTDAESETGIPKSLSNEPPSETMEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPLKSWARCRDF

SEQ ID NO: 62473 - protein, 369 aa, Homo sapiens
  Payload ID: 12483
  Gene Symbol: PCYT1B
  Gene Name: phosphate cytidylyltransferase 1, choline, beta
  Uniprot ID: Q9Y5K3
  ENSP ID: ENSP00000368439
MPVVTTDAESETGIPKSLSNEPPSETMEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPVSSPTRSRSPSRSPSPTFSWLPLKTSPPSSPKAASASISSMSEGDEDEK

SEQ ID NO: 62474 - protein, 351 aa, Homo sapiens
  Payload ID: 12483
  Gene Symbol: PCYT1B
  Gene Name: phosphate cytidylyltransferase 1, choline, beta
  Uniprot ID: Q9Y5K3
  ENSP ID: ENSP00000368440
MVGHQECIMEEDNRAPQLWRKTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPVSSPTRSRSPSRSPSPTFSWLPLKTSPPSSPKAASASISSMSEGDEDEK

SEQ ID NO: 62475 - protein, 177 aa, Homo sapiens
  Payload ID: 12483
  Gene Symbol: PCYT1B
  Gene Name: phosphate cytidylyltransferase 1, choline, beta
  ENSP ID: ENSP00000436562
MEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKGCSFQRREQKASQHRTSLPELFVTMMFMPDVTSREGIQPRN

SEQ ID NO: 62476 - protein, 311 aa, Homo sapiens
  Payload ID: 12484
  Gene Symbol: PCYT2
  Gene Name: phosphate cytidylyltransferase 2, ethanolamine
  Uniprot ID: Q99447
  ENSP ID: ENSP00000331719
MVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 62477 - protein, 389 aa, Homo sapiens
  Payload ID: 12484
  Gene Symbol: PCYT2
  Gene Name: phosphate cytidylyltransferase 2, ethanolamine
  Uniprot ID: Q99447
  ENSP ID: ENSP00000439245
MIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 62478 - protein, 407 aa, Homo sapiens
  Payload ID: 12484
  Gene Symbol: PCYT2
  Gene Name: phosphate cytidylyltransferase 2, ethanolamine
  Uniprot ID: Q99447
  ENSP ID: ENSP00000442050
MIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKPPHPIPAGDILSSEGCSQCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 62479 - protein, 311 aa, Homo sapiens; identical to SEQ ID NO: 62476
  Payload ID: 12484
  Gene Symbol: PCYT2
  Gene Name: phosphate cytidylyltransferase 2, ethanolamine
  Uniprot ID: Q99447
  ENSP ID: ENSP00000458330

SEQ ID NO: 62480 - protein, 44 aa, Homo sapiens
  Payload ID: 12484
  Gene Symbol: PCYT2
  Gene Name: phosphate cytidylyltransferase 2, ethanolamine
  ENSP ID: ENSP00000458472
MIRNGRGAAGGAEQPGPGGRRAVRVWCDGCHRAEIWSHGLPASP

SEQ ID NO: 62481 - protein, 81 aa, Homo sapiens
  Payload ID: 12484
  Gene Symbol: PCYT2
  Gene Name: phosphate cytidylyltransferase 2, ethanolamine
  ENSP ID: ENSP00000458727
MVQAIKWVDEVVPAAPYVTTLETLDKYNCDFCVHGNDITLTVDGRDTYEEVKQAGRYRECKRTQGVSTTDLVGRMLLVTKA

SEQ ID NO: 62482 - protein, 34 aa, Homo sapiens
  Payload ID: 12484
  Gene Symbol: PCYT2
  Gene Name: phosphate cytidylyltransferase 2, ethanolamine
  ENSP ID: ENSP00000458805
MVQAIKWVDEVVPAAPYVTTLETLDKYNCDFCVH

SEQ ID NO: 62483 - protein, 314 aa, Homo sapiens
  Payload ID: 12484
  Gene Symbol: PCYT2
  Gene Name: phosphate cytidylyltransferase 2, ethanolamine
  ENSP ID: ENSP00000458931
MIRNGRGAAGGAEQPGPGGRRAVRVWCDGCYDMVHYGHSNQLRQARAMGDYLIVGVHTDDDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKEL

SEQ ID NO: 62484 - protein, 367 aa, Homo sapiens
  Payload ID: 12484
  Gene Symbol: PCYT2
  Gene Name: phosphate cytidylyltransferase 2, ethanolamine
  ENSP ID: ENSP00000459044
MIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKEPKRRGIFRQIDSGSNLTTDLIVQRIITNRLEYEARNQKKEAKELAFLEAARQQAAQPLGERDGDF

SEQ ID NO: 62485 - protein, 286 aa, Homo sapiens
  Payload ID: 12484
  Gene Symbol: PCYT2
  Gene Name: phosphate cytidylyltransferase 2, ethanolamine
  ENSP ID: ENSP00000459836
MIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFK

SEQ ID NO: 62486 - protein, 207 aa, Homo sapiens
  Payload ID: 12484
  Gene Symbol: PCYT2
  Gene Name: phosphate cytidylyltransferase 2, ethanolamine
  ENSP ID: ENSP00000460767
  MOD_RES (1)..(1): Any amino acid
XKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 62487 - protein, 357 aa, Homo sapiens
  Payload ID: 12484
  Gene Symbol: PCYT2
  Gene Name: phosphate cytidylyltransferase 2, ethanolamine
  Uniprot ID: Q99447
  ENSP ID: ENSP00000461190
MVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 62488 - protein, 53 aa, Homo sapiens
  Payload ID: 12484
  Gene Symbol: PCYT2
  Gene Name: phosphate cytidylyltransferase 2, ethanolamine
  ENSP ID: ENSP00000461814
MVHYGHSNQLRQARAMGDYLIVGVHTDGGEIQDGAGHQMGGRGGASGSLRHYT

SEQ ID NO: 62489 - protein, 749 aa, Homo sapiens
  Payload ID: 12485
  Gene Symbol: PHEX
  Gene Name: phosphate regulating endopeptidase homolog, X-linked
  Uniprot ID: P78562
  ENSP ID: ENSP00000368682
MEAETGSSVETGKKANRGTRIALVVFVGGTLVLGTILFLVSQGLLSLQAKQEYCLKPECIEAAAAILSKVNLSVDPCDNFFRFACDGWISNNPIPEDMPSYGVYPWLRHNVDLKLKELLEKSISRRRDTEAIQKAKILYSSCMNEKAIEKADAKPLLHILRHSPFRWPVLESNIGPEGVWSERKFSLLQTLATFRGQYSNSVFIRLYVSPDDKASNEHILKLDQATLSLAVREDYLDNSTEAKSYRDALYKFMVDTAVLLGANSSRAEHDMKSVLRLEIKIAEIMIPHENRTSEAMYNKMNISELSAMIPQFDWLGYIKKVIDTRLYPHLKDISPSENVVVRVPQYFKDLFRILGSERKKTIANYLVWRMVYSRIPNLSRRFQYRWLEFSRVIQGTTTLLPQWDKCVNFIESALPYVVGKMFVDVYFQEDKKEMMEELVEGVRWAFIDMLEKENEWMDAGTKRKAKEKARAVLAKVGYPEFIMNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRAYRKWINDRRQGLEEPLLPGITFTNNQLFFLSYAHVRCNSYRPEAAREQVQIGAHSPPQFRVNGAISNFEEFQKAFNCPPNSTMNRGMDSCRLW

SEQ ID NO: 62490 - protein, 214 aa, Homo sapiens
  Payload ID: 12486
  Gene Symbol: PCTP
  Gene Name: phosphatidylcholine transfer protein
  Uniprot ID: Q9UKL6
  ENSP ID: ENSP00000268896
MELAAGSFSEEQFWEACAELQQPALAGADWQLLVETSGISIYRLLDKKTGLYEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKNGVPNFLKDMARACQNYLKKT

SEQ ID NO: 62491 - protein, 142 aa, Homo sapiens
  Payload ID: 12486
  Gene Symbol: PCTP
  Gene Name: phosphatidylcholine transfer protein
  Uniprot ID: Q9UKL6
  ENSP ID: ENSP00000325181
MDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKNGVPNFLKDMARACQNYLKKT

SEQ ID NO: 62492 - protein, 64 aa, Homo sapiens
  Payload ID: 12486
  Gene Symbol: PCTP
  Gene Name: phosphatidylcholine transfer protein
  ENSP ID: ENSP00000415185
MDSDYRKQWDQYVKELYEQECNGETVVYWEVKYPFPMSNRDVSFPQACGAFLLSVYNAGVGVLP

SEQ ID NO: 62493 - protein, 203 aa, Homo sapiens
  Payload ID: 12486
  Gene Symbol: PCTP
  Gene Name: phosphatidylcholine transfer protein
  ENSP ID: ENSP00000459793
MELAAGSFSEEQFWEACAELQQPALAGADWQLLVETSGISIYRLLDKKTGLYEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKGGNCSGSLYH

SEQ ID NO: 62494 - protein, 219 aa, Homo sapiens
  Payload ID: 12486
  Gene Symbol: PCTP
  Gene Name: phosphatidylcholine transfer protein
  ENSP ID: ENSP00000460437
MELAAGSFSEEQFWEACAELQQPALAGADWQLLVETSGISIYRLLDKKTGLYEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKNQSRTKREAQNQRDLIKFLANPNILQ

SEQ ID NO: 62495 - protein, 146 aa, Homo sapiens
  Payload ID: 12486
  Gene Symbol: PCTP
  Gene Name: phosphatidylcholine transfer protein
  ENSP ID: ENSP00000461676
RQRRDLDMEGRKIHVILARSTSMPQLGERSGVIRVKQYKQSLAIESDGKKGSKVFMYYFDNPGGQIPSWLINWAAKAGLELLTSSNPLASASQSAGITGMSHHTRPIRAEPSGKLRIRETSSSFWQTQTFCNRLSGRKRKDIKIKT

SEQ ID NO: 62496 - protein, 187 aa, Homo sapiens
  Payload ID: 12487
  Gene Symbol: PEBP1
  Gene Name: phosphatidylethanolamine binding protein 1
  Uniprot ID: P30086
  ENSP ID: ENSP00000261313
MPVDLSKWSGPLSLQEVDEQPQHPLHVTYAGAAVDELGKVLTPTQVKNRPTSISWDGLDSGKLYTLVLTDPDAPSRKDPKYREWHHFLVVNMKGNDISSGTVLSDYVGSGPPKGTGLHRYVWLVYEQDRPLKCDEPILSNRSGDHRGKFKVASFRKKYELRAPVAGTCYQAEWDDYVPKLYEQLSGK

SEQ ID NO: 62497 - protein, 236 aa, Homo sapiens
  Payload ID: 12488
  Gene Symbol: PEMT
  Gene Name: phosphatidylethanolamine N-methyltransferase
  Uniprot ID: Q9UBM1
  ENSP ID: ENSP00000255389
MKRSGNPGAEVTNSSVAGPDCCGGLGNIDFRQADFCVMTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIVALLYEEPFTAEIYRQKASGSHKRS

SEQ ID NO: 62498 - protein, 232 aa, Homo sapiens
  Payload ID: 12488
  Gene Symbol: PEMT
  Gene Name: phosphatidylethanolamine N-methyltransferase
  Uniprot ID: Q9UBM1
  ENSP ID: ENSP00000379127
MKRSGNPGAEVTNSSVAGPDCCGGLGNIDFRQADFCVMTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIIPAPAGAVGSEARQPHGPAPDGAGGPHLHSGSPIRRALHR

SEQ ID NO: 62499 - protein, 199 aa, Homo sapiens
  Payload ID: 12488
  Gene Symbol: PEMT
  Gene Name: phosphatidylethanolamine N-methyltransferase
  Uniprot ID: Q9UBM1
  ENSP ID: ENSP00000379128
MTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIVALLYEEPFTAEIYRQKASGSHKRS

SEQ ID NO: 62500 - protein, 199 aa, Homo sapiens; identical to SEQ ID NO: 62499
  Payload ID: 12488
  Gene Symbol: PEMT
  Gene Name: phosphatidylethanolamine N-methyltransferase
  Uniprot ID: Q9UBM1
  ENSP ID: ENSP00000379129

SEQ ID NO: 62501 - protein, 211 aa, Homo sapiens
  Payload ID: 12488
  Gene Symbol: PEMT
  Gene Name: phosphatidylethanolamine N-methyltransferase
  ENSP ID: ENSP00000391288
MKRSGNPGAEADFCVMTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIISPAPAGAVGSEARQPHGPAPDGAGGPHLHSGSPIRRALHR

SEQ ID NO: 62502 - protein, 79 aa, Homo sapiens
  Payload ID: 12488
  Gene Symbol: PEMT
  Gene Name: phosphatidylethanolamine N-methyltransferase
  ENSP ID: ENSP00000463112
MKRSGNPGAEVTNSSVAGPDCCGGLGNIDFRQADFCVMTRLLGYVDPLDPSFVAAVITITFNPLYWNVVITSGSSRRRE

SEQ ID NO: 62503 - protein, 97 aa, Homo sapiens
  Payload ID: 12488
  Gene Symbol: PEMT
  Gene Name: phosphatidylethanolamine N-methyltransferase
  ENSP ID: ENSP00000463713
MKRSGNPGAEVTNSSVAGPDCCGGLGNIDFRQADFCVMTRLLGYVDPLDPSFVAAVITITFNPLYWNVVLVAGEPGLAVGTLRLQARLHDGNTRPAS

SEQ ID NO: 62504 - protein, 227 aa, Homo sapiens
  Payload ID: 12489
  Gene Symbol: PEBP4
  Gene Name: phosphatidylethanolamine-binding protein 4
  Uniprot ID: Q96S96
  ENSP ID: ENSP00000256404
MGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 62505 - protein, 93 aa, Homo sapiens
  Payload ID: 12489
  Gene Symbol: PEBP4
  Gene Name: phosphatidylethanolamine-binding protein 4
  ENSP ID: ENSP00000429414
MSRRRAEPGCGGSGRRAGAPGEGRGRRRYAPGPAAKALPRRRLALQSQVPMGWTMRLVTAALLLGLMMVVTGDEDENSPCAHEALLDEDTLFC

SEQ ID NO: 62506 - protein, 556 aa, Homo sapiens
  Payload ID: 12490
  Gene Symbol: PGS1
  Gene Name: phosphatidylglycerophosphate synthase 1
  Uniprot ID: Q32NB8
  ENSP ID: ENSP00000262764
MAVAAAAAAGPVFWRRLLGLLPGRPGLAALLGRLSDRLGRNRDRQRRRSPWLLLAPLLSPAVPQVTSPPCCLCPEGVHRFQWIRNLVPEFGVSSSHVRVLSSPAEFFELMKGQIRVAKRRVVMASLYLGTGPLEQELVDCLESTLEKSLQAKFPSNLKVSILLDFTRGSRGRKNSRTMLLPLLRRFPEQVRVSLFHTPHLRGLLRLLIPERFNETIGLQHIKVYLFDNSVILSGANLSDSYFTNRQDRYVFLQDCAEIADFFTELVDAVGDVSLQLQGDDTVQVVDGMVHPYKGDRAEYCKAANKRVMDVINSARTRQQMLHAQTFHSNSLLTQEDAAAAGDRRPAPDTWIYPLIQMKPFEIQIDEIVTETLLTEAERGAKVYLTTGYFNLTQAYMDLVLGTRAEYQILLASPEVNGFFGAKGVAGAIPAAYVHIERQFFSEVCSLGQQERVQLQEYWRRGWTFHAKGLWLYLAGSSLPCLTLIGSPNFGYRSVHRDLEAQIAIVTENQALQQQLHQEQEQLYLRSGVVSSATFEQPSRQVKLWVKMVTPLIKNFF

SEQ ID NO: 62507 - protein, 264 aa, Homo sapiens
  Payload ID: 12490
  Gene Symbol: PGS1
  Gene Name: phosphatidylglycerophosphate synthase 1
  ENSP ID: ENSP00000465266
  MOD_RES (1)..(1): Any amino acid
XRQLRRDPCSGGDCWASCLAAQGWPRSWDACPTASAGTGTASAGAVPQVTSPPCCLCPEGVHRFQWIRNLVPEFGVSSSHVRVLSSPAEFFELMKGQIRVAKRRVVMASLYLGTGPLEQELVDCLESTLEKSLQAKFPSNLKVSILLDFTRGSRGRKNSRTMLLPLLRRFPEQVRVSLFHTPHLRGLLRLLIPERFNETIGLQHIKVYLFDNSVILSGTATCSCRTVRRLPTSSRSWWTRWGMCPCSCRGTTRCRWWMGWCILT

SEQ ID NO: 62508 - protein, 50 aa, Homo sapiens
  Payload ID: 12490
  Gene Symbol: PGS1
  Gene Name: phosphatidylglycerophosphate synthase 1
  Uniprot ID: Q32NB8
  ENSP ID: ENSP00000465278
MAVAAAAAAGPVFWRRLLGLLPGRPGLAALLGRLSDRLGRNRDRQRRRGR

SEQ ID NO: 62509 - protein, 384 aa, Homo sapiens
  Payload ID: 12490
  Gene Symbol: PGS1
  Gene Name: phosphatidylglycerophosphate synthase 1
  ENSP ID: ENSP00000465908
MAVAAAAAAGPVFWRRLLGLLPGRPGLAALLGRLSDRLGRNRDRQRRRSPWLLLAPLLSPAVPQVTSPPCCLCPEGVHRFQWIRNLVPEFGVSSSHVRVLSSPAEFFELMKVDCLESTLEKSLQAKFPSNLKVSILLDFTRGSRGRKNSRTMLLPLLRRFPEQVRVSLFHTPHLRGLLRLLIPERFNETIGLQHIKVYLFDNSVILSGANLSDSYFTNRQDRYVFLQDCAEIADFFTELVDAVGDVSLQLQGDDTVQVVDGMVHPYKGDRAEYCKAANKRVMDVINSARTRQQMLHAQTFHSNSLLTQEDAAAAGDRRPAPDTWIYPLIQMKPFEIQIDEIVTETLLTEAERGAKVYLTTGYFNLTQAYMDLVLGTRAEYQILL

SEQ ID NO: 62510 - protein, 329 aa, Homo sapiens
  Payload ID: 12490
  Gene Symbol: PGS1
  Gene Name: phosphatidylglycerophosphate synthase 1
  ENSP ID: ENSP00000466219
  MOD_RES (1)..(1): Any amino acid
XVAAAAAAGPVFWRRLLGLLPGRPGLAALLGRLSDRLGRNRDRQRRRSPWLLLAPLLSPAVPQVTSPPCCLCPEGVHRFQWIRNLVPEFGVSSSHVRVLSSPAEFFELMKGQIRVAKRRVVMASLYLGTGPLEQELVDCLESTLEKSLQAKFPSNLKVSILLDFTRGSRGRKNSRTMLLPLLRRFPEQVRVSLFHTPHLRGLLRLLIPERFNETIGLQHIKVYLFDNSVILSGANLSDSYFTNRQDRYVFLQDCAEIADFFTELVDAVGDVSLQLQGDDTVQVVDGMVHPYKGDRAEYCKAANKRVMDVINSARTRQQMLHAQTFHSNS

SEQ ID NO: 62511 - protein, 132 aa, Homo sapiens
  Payload ID: 12490
  Gene Symbol: PGS1
  Gene Name: phosphatidylglycerophosphate synthase 1
  ENSP ID: ENSP00000467569
  MOD_RES (1)..(1): Any amino acid
XLTTGYFNLTQAYMDLVLGTRAEYQILLASPEVNGFFGAKGVAGAIPAAYVHIERQFFSEVCSLGQQERVQLQEYWRRGWTFHAKGARAALPEVRCGVLCHLRAAESPGEAVGEDGDSTDQELLLRTDRCCL

SEQ ID NO: 62512 - protein, 114 aa, Homo sapiens
  Payload ID: 12490
  Gene Symbol: PGS1
  Gene Name: phosphatidylglycerophosphate synthase 1
  ENSP ID: ENSP00000467719
APSQRPMCTSSDSSSVRCAAWDSRSGSSFRSTGGGAGRSTPKVSSPGPGGPDCDRDGEPGPAAAASPGARAALPEVRCGVLCHLRAAESPGEAVGEDGDSTDQELLLRTDRCCL

SEQ ID NO: 62513 - protein, 84 aa, Homo sapiens
  Payload ID: 12490
  Gene Symbol: PGS1
  Gene Name: phosphatidylglycerophosphate synthase 1
  ENSP ID: ENSP00000467804
MAVAAAAAAGPVFWRRLLGLLPGRPGLAALLGRLSDRLGRNRDRQRRSCSPGHLPTLLPVSRRRAPVPVDQKPGSRIWSLQFSR

SEQ ID NO: 62514 - protein, 454 aa, Homo sapiens
  Payload ID: 12490
  Gene Symbol: PGS1
  Gene Name: phosphatidylglycerophosphate synthase 1
  Uniprot ID: Q32NB8
  ENSP ID: ENSP00000468431
MAVAAAAAAGPVFWRRLLGLLPGRPGLAALLGRLSDRLGRNRDRQRRRSPWLLLAPLLSPAVPQVTSPPCCLCPEGVHRFQWIRNLVPEFGVSSSHVRVLSSPAEFFELMKVDCLESTLEKSLQAKFPSNLKVSILLDFTRGSRGRKNSRTMLLPLLRRFPEQVRVSLFHTPHLRGLLRLLIPERFNETIGLQHIKVYLFDNSVILSGANLSDSYFTNRQDRYVFLQDCAEIADFFTELVDAVGDVSLQLQGDDTVQVVDGMVHPYKGDRAEYCKAANKRVMDVINSARTRQQMLHAQTFHSNSLLTQEDAAAAGDRRPAPDTWIYPLIQMKPFEIQIDEIVTETLLTEAERGAKVYLTTGYFNLTQAYMDLVLGTRAEYQILLASPEVNGFFGAKGVAGAIPAAYVHIERQFFSEVCSLGQQERVQLQEYWRRGWTFHAKGQFTGTWRPRLRS

SEQ ID NO: 62515 - protein, 150 aa, Homo sapiens
  Payload ID: 12490
  Gene Symbol: PGS1
  Gene Name: phosphatidylglycerophosphate synthase 1
  ENSP ID: ENSP00000475797
MAVAAAAAAGPVFWRRLLGLLPGRPGLAALLGRLSDRLGRNRDRQRRRWSPTLSPRLECNGTISAHCKLRLPGSSDSPASASGVAGNTGHHGCYWLPCCPQLFPRSPPHLAACVQKACTGSSGSETWFQNLESPVLTLGCFLPRQSFSSS

SEQ ID NO: 62516 - protein, 728 aa, Homo sapiens
  Payload ID: 12491
  Gene Symbol:
  Gene Name: Phosphatidylinositol 3-kinase regulatory subunit beta  [Source:UniProtKB/Swiss-Prot
  Acc:O00459]
  Uniprot ID: O00459
  ENSP ID: ENSP00000471914
MAGPEGFQYRALYPFRRERPEDLELLPGDVLVVSRAALQALGVAEGGERCPQSVGWMPGLNERTRQRGDFPGTYVEFLGPVALARPGPRPRGPRPLPARPRDGAPEPGLTLPDLPEQFSPPDVAPPLLVKLVEAIERTGLDSESHYRPELPAPRTDWSLSDVDQWDTAALADGIKSFLLALPAPLVTPEASAEARRALREAAGPVGPALEPPTLPLHRALTLRFLLQHLGRVASRAPALGPAVRALGATFGPLLLRAPPPPSSPPPGGAPDGSEPSPDFPALLVEKLLQEHLEEQEVAPPALPPKPPKAKPASTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPPAAR

SEQ ID NO: 62517 - protein, 887 aa, Homo sapiens
  Payload ID: 12492
  Gene Symbol: PIK3C3
  Gene Name: phosphatidylinositol 3-kinase, catalytic subunit type 3
  Uniprot ID: Q8NEB9
  ENSP ID: ENSP00000262039
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESEKRSSNFMYLMVEFRCVKCDDKEYGIVYYEKDGDESSPILTSFELVKVPDPQMSMENLVESKHHKLARSLRSGPSDHDLKPNAATRDQLNIIVSYPPTKQLTYEEQDLVWKFRYYLTNQEKALTKFLKCVNWDLPQEAKQALELLGKWKPMDVEDSLELLSSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVIVECEDQDTQQRDPKTHEMYLNVMRRFSQALLKGDKSVRVMRSLLAAQQTFVDRLVHLMKAVQRESGNRKKKNERLQALLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGKLFHIDFGYILGRDPKPLPPPMKLNKEMVEGMGGTQSEQYQEFRKQCYTAFLHLRRYSNLILNLFSLMVDANIPDIALEPDKTVKKVQDKFRLDLSDEEAVHYMQSLIDESVHALFAAVVEQIHKFAQYWRK

SEQ ID NO: 62518 - protein, 824 aa, Homo sapiens
  Payload ID: 12492
  Gene Symbol: PIK3C3
  Gene Name: phosphatidylinositol 3-kinase, catalytic subunit type 3
  ENSP ID: ENSP00000381845
MGEAEKFHYIYSCDLDINVQLKIWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESEKRSSNFMYLMVEFRCVKCDDKEYGIVYYEKDGDESSPILTSFELVKVPDPQMSMENLVESKHHKLARSLRSGPSDHDLKPNAATRDQLNIIVSYPPTKQLTYEEQDLVWKFRYYLTNQEKALTKFLKCVNWDLPQEAKQALELLGKWKPMDVEDSLELLSSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVIVECEDQDTQQRDPKTHEMYLNVMRRFSQALLKGDKSVRVMRSLLAAQQTFVDRLVHLMKAVQRESGNRKKKNERLQALLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGKLFHIDFGYILGRDPKPLPPPMKLNKEMVEGMGGTQSEQYQEFRKQCYTAFLHLRRYSNLILNLFSLMVDANIPDIALEPDKTVKKVQDKFRLDLSDEEAVHYMQSLIDESVHALFAAVVEQIHKFAQYWRK

SEQ ID NO: 62519 - protein, 178 aa, Homo sapiens
  Payload ID: 12492
  Gene Symbol: PIK3C3
  Gene Name: phosphatidylinositol 3-kinase, catalytic subunit type 3
  ENSP ID: ENSP00000464909
  MOD_RES (1)..(1): Any amino acid
XGLLGVRGRKGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKVKKVIWNRCKALTD

SEQ ID NO: 62520 - protein, 201 aa, Homo sapiens
  Payload ID: 12492
  Gene Symbol: PIK3C3
  Gene Name: phosphatidylinositol 3-kinase, catalytic subunit type 3
  ENSP ID: ENSP00000465621
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKVKKVIWNRCKALTDVYCSIYTLTL

SEQ ID NO: 62521 - protein, 134 aa, Homo sapiens
  Payload ID: 12492
  Gene Symbol: PIK3C3
  Gene Name: phosphatidylinositol 3-kinase, catalytic subunit type 3
  ENSP ID: ENSP00000466946
  MOD_RES (1)..(1): Any amino acid
XSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKQK

SEQ ID NO: 62522 - protein, 104 aa, Homo sapiens
  Payload ID: 12492
  Gene Symbol: PIK3C3
  Gene Name: phosphatidylinositol 3-kinase, catalytic subunit type 3
  ENSP ID: ENSP00000471957
MDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGNN

SEQ ID NO: 62523 - protein, 183 aa, Homo sapiens
  Payload ID: 12492
  Gene Symbol: PIK3C3
  Gene Name: phosphatidylinositol 3-kinase, catalytic subunit type 3
  ENSP ID: ENSP00000472926
  MOD_RES (1)..(1): Any amino acid
XLLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGNN

SEQ ID NO: 62524 - protein, 103 aa, Homo sapiens
  Payload ID: 12492
  Gene Symbol: PIK3C3
  Gene Name: phosphatidylinositol 3-kinase, catalytic subunit type 3
  ENSP ID: ENSP00000473061
MDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGG

SEQ ID NO: 62525 - protein, 479 aa, Homo sapiens
  Payload ID: 12493
  Gene Symbol: PI4K2A
  Gene Name: phosphatidylinositol 4-kinase type 2 alpha
  Uniprot ID: Q9BTU6
  ENSP ID: ENSP00000359665
MDETSPLVSPERAQPPDYTFPSGSGAHFPQVPGGAVRVAAAAGSGPSPPGSPGHDRERQPLLDRARGAAAQGQTQTVAAQAQALAAQAAAAAHAAQAHRERNEFPEDPEFEAVVRQAELAIERCIFPERIYQGSSGSYFVKDPQGRIIAVFKPKNEEPYGHLNPKWTKWLQKLCCPCCFGRDCLVLNQGYLSEAGASLVDQKLELNIVPRTKVVYLASETFNYSAIDRVKSRGKRLALEKVPKVGQRFNRIGLPPKVGSFQLFVEGYKDADYWLRRFEAEPLPENTNRQLLLQFERLVVLDYIIRNTDRGNDNWLIKYDCPMDSSSSRDTDWVVVKEPVIKVAAIDNGLAFPLKHPDSWRAYPFYWAWLPQAKVPFSQEIKDLILPKISDPNFVKDLEEDLYELFKKDPGFDRGQFHKQIAVMRGQILNLTQALKDNKSPLHLVQMPPVIVETARSHQRSSSESYTQSFQSRKPFFSWW

SEQ ID NO: 62526 - protein, 481 aa, Homo sapiens
  Payload ID: 12494
  Gene Symbol: PI4K2B
  Gene Name: phosphatidylinositol 4-kinase type 2 beta
  Uniprot ID: Q8TCG2
  ENSP ID: ENSP00000264864
MEDPSEPDRLASADGGSPEEEEDGEREPLLPRIAWAHPRRGAPGSAVRLLDAAGEEGEAGDEELPLPPGDVGVSRSSSAELDRSRPAVSVTIGTSEMNAFLDDPEFADIMLRAEQAIEVGIFPERISQGSSGSYFVKDPKRKIIGVFKPKSEEPYGQLNPKWTKYVHKVCCPCCFGRGCLIPNQGYLSEAGAYLVDNKLHLSIVPKTKVVWLVSETFNYNAIDRAKSRGKKYALEKVPKVGRKFHRIGLPPKIGSFQLFVEGYKEAEYWLRKFEADPLPENIRKQFQSQFERLVILDYIIRNTDRGNDNWLVRYEKQKCEKEIDHKESKWIDDEEFLIKIAAIDNGLAFPFKHPDEWRAYPFHWAWLPQAKVPFSEEIRNLILPYISDMNFVQDLCEDLYELFKTDKGFDKATFESQMSVMRGQILNLTQALRDGKSPFQLVQIPCVIVERSQGGSQGRIVHLSNSFTQTVNCRKPFFSSW

SEQ ID NO: 62527 - protein, 2102 aa, Homo sapiens
  Payload ID: 12495
  Gene Symbol: PI4KA
  Gene Name: phosphatidylinositol 4-kinase, catalytic, alpha
  ENSP ID: ENSP00000255882
MAAAPARGGGGGGGGGGGCSGSGSSASRGFYFNTVLSLARSLAVQRPASLEKVQKLLCMCPVDFHGIFQLDERRRDAVIALGIFLIESDLQHKDCVVPYLLRLLKGLPKVYWVEESTARKGRGALPVAESFSFCLVTLLSDVAYRDPSLRDEILEVLLQVLHVLLGMCQALEIQDKEYLCKYAIPCLIGISRAFGRYSNMEESLLSKLFPKIPPHSLRVLEELEGVRRRSFNDFRSILPSNLLTVCQEGTLKRKTSSVSSISQVSPERGMPPPSSPGGSAFHYFEASCLPDGTALEPEYYFSTISSSFSVSPLFNGVTYKEFNIPLEMLRELLNLVKKIVEEAVLKSLDAIVASVMEANPSADLYYTSFSDPLYLTMFKMLRDTLYYMKDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 62528 - protein, 435 aa, Homo sapiens
  Payload ID: 12495
  Gene Symbol: PI4KA
  Gene Name: phosphatidylinositol 4-kinase, catalytic, alpha
  ENSP ID: ENSP00000382162
MGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDEALSAQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 62529 - protein, 87 aa, Homo sapiens
  Payload ID: 12495
  Gene Symbol: PI4KA
  Gene Name: phosphatidylinositol 4-kinase, catalytic, alpha
  ENSP ID: ENSP00000402437
MCPVDFHGIFQLDERRRDAVIALGIFLIESDLQHKDCVVPYLLRLLKGLPKVYWVEESTARKGRGALPVAESFSFCLVTLLSDVAYR

SEQ ID NO: 62530 - protein, 801 aa, Homo sapiens
  Payload ID: 12496
  Gene Symbol: PI4KB
  Gene Name: phosphatidylinositol 4-kinase, catalytic, beta
  Uniprot ID: Q9UBF8
  ENSP ID: ENSP00000357866
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 62531 - protein, 816 aa, Homo sapiens
  Payload ID: 12496
  Gene Symbol: PI4KB
  Gene Name: phosphatidylinositol 4-kinase, catalytic, beta
  Uniprot ID: Q9UBF8
  ENSP ID: ENSP00000357867
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEELSSSTESIDNSFSSPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 62532 - protein, 801 aa, Homo sapiens; identical to SEQ ID NO: 62530
  Payload ID: 12496
  Gene Symbol: PI4KB
  Gene Name: phosphatidylinositol 4-kinase, catalytic, beta
  Uniprot ID: Q9UBF8
  ENSP ID: ENSP00000357868

SEQ ID NO: 62533 - protein, 828 aa, Homo sapiens
  Payload ID: 12496
  Gene Symbol: PI4KB
  Gene Name: phosphatidylinositol 4-kinase, catalytic, beta
  ENSP ID: ENSP00000357869
MRFLEARSLAVAMGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEELSSSTESIDNSFSSPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 62534 - protein, 73 aa, Homo sapiens
  Payload ID: 12496
  Gene Symbol: PI4KB
  Gene Name: phosphatidylinositol 4-kinase, catalytic, beta
  ENSP ID: ENSP00000391546
  MOD_RES (1)..(1): Any amino acid
XSSPRNLGFETSAFKLTTEFVDVMGGLDGDMFNYYKMLMLQGLIAARKHMDKVLSFLASMAPAPFETSKRGST

SEQ ID NO: 62535 - protein, 280 aa, Homo sapiens
  Payload ID: 12496
  Gene Symbol: PI4KB
  Gene Name: phosphatidylinositol 4-kinase, catalytic, beta
  ENSP ID: ENSP00000394719
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDAT

SEQ ID NO: 62536 - protein, 227 aa, Homo sapiens
  Payload ID: 12496
  Gene Symbol: PI4KB
  Gene Name: phosphatidylinositol 4-kinase, catalytic, beta
  ENSP ID: ENSP00000410974
EPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGCRRCSGSSPSGPMMTVAQVICSQLPCFHGSSTIRNLKERFHMSMTEEQLQLLVEQMVDGSMRSITTKLYDGFQYLTNGIM

SEQ ID NO: 62537 - protein, 191 aa, Homo sapiens
  Payload ID: 12496
  Gene Symbol: PI4KB
  Gene Name: phosphatidylinositol 4-kinase, catalytic, beta
  ENSP ID: ENSP00000413599
MAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKR

SEQ ID NO: 62538 - protein, 95 aa, Homo sapiens
  Payload ID: 12496
  Gene Symbol: PI4KB
  Gene Name: phosphatidylinositol 4-kinase, catalytic, beta
  ENSP ID: ENSP00000431501
MAIGKRLATLPTKEQKTQRLISELSLLNHKLPARVWLPTAGFDHHVVRVPHTQAVVLNSKDKAPYLIYVEVLECENFDTTSVPARIPENRIRSTR

SEQ ID NO: 62539 - protein, 183 aa, Homo sapiens
  Payload ID: 12496
  Gene Symbol: PI4KB
  Gene Name: phosphatidylinositol 4-kinase, catalytic, beta
  ENSP ID: ENSP00000432426
PYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGGAGVRSGAIVPQASPLSRSPGA

SEQ ID NO: 62540 - protein, 484 aa, Homo sapiens
  Payload ID: 12496
  Gene Symbol: PI4KB
  Gene Name: phosphatidylinositol 4-kinase, catalytic, beta
  Uniprot ID: Q9UBF8
  ENSP ID: ENSP00000433149
MAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 62541 - protein, 632 aa, Homo sapiens
  Payload ID: 12497
  Gene Symbol: PICALM
  Gene Name: phosphatidylinositol binding clathrin assembly protein
  Uniprot ID: Q13492
  ENSP ID: ENSP00000348718
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDPFSATVDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMPPQMGSVPVMTQPTLIYSQPVMRPPNPFGPVSGAQIQFM

SEQ ID NO: 62542 - protein, 652 aa, Homo sapiens
  Payload ID: 12497
  Gene Symbol: PICALM
  Gene Name: phosphatidylinositol binding clathrin assembly protein
  Uniprot ID: Q13492
  ENSP ID: ENSP00000377015
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDPFSATVDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMAPPVMAYPATTPTGMIGYGIPPQMGSVPVMTQPTLIYSQPVMRPPNPFGPVSGAQIQFM

SEQ ID NO: 62543 - protein, 148 aa, Homo sapiens
  Payload ID: 12497
  Gene Symbol: PICALM
  Gene Name: phosphatidylinositol binding clathrin assembly protein
  ENSP ID: ENSP00000431545
MGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFN

SEQ ID NO: 62544 - protein, 105 aa, Homo sapiens
  Payload ID: 12497
  Gene Symbol: PICALM
  Gene Name: phosphatidylinositol binding clathrin assembly protein
  ENSP ID: ENSP00000431728
MSGQSLTDRITAAQHSVTGSAVSKTVCKATTHEIMGPKKKHLDYLIQCTNEMNVNIPQLADSLFERTTNSSWVVVFKSLITTHHLMVYGNEDMTCLHLLGGIVDI

SEQ ID NO: 62545 - protein, 244 aa, Homo sapiens
  Payload ID: 12497
  Gene Symbol: PICALM
  Gene Name: phosphatidylinositol binding clathrin assembly protein
  ENSP ID: ENSP00000432509
  MOD_RES (1)..(1): Any amino acid
XAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMIQFM

SEQ ID NO: 62546 - protein, 264 aa, Homo sapiens
  Payload ID: 12497
  Gene Symbol: PICALM
  Gene Name: phosphatidylinositol binding clathrin assembly protein
  ENSP ID: ENSP00000432976
  MOD_RES (1)..(1): Any amino acid
XTSKLPNDLLDLQQPTFHPSVHPMSTASQVASTWGDAVDDAIPSLNPFLTKSSGDVHLSISSDVSTFTTRTPTHEMFVGFTPSPVAQPHPSAGLNVDFESVFGNKSTNVIVDSGGGLLKPTVASQNQNLPVAKLPPSKLVSDDLDSSLANLVGNLGIGNGTTKNDVNWSQPGEKKLTGGSNWQPKVAPTTAWNAATMNGMHFPQYAPPVMAYPATTPTGMIGYGIPPQMGSVPVMTQPTLIYSQPVMRPPNPFGPVSGAQIQFM

SEQ ID NO: 62547 - protein, 48 aa, Homo sapiens
  Payload ID: 12497
  Gene Symbol: PICALM
  Gene Name: phosphatidylinositol binding clathrin assembly protein
  ENSP ID: ENSP00000433166
MSGQSLTDRITAAQHSVTGSAVSKTVCKATTHEIMGPKKKHLDWLMEL

SEQ ID NO: 62548 - protein, 185 aa, Homo sapiens
  Payload ID: 12497
  Gene Symbol: PICALM
  Gene Name: phosphatidylinositol binding clathrin assembly protein
  ENSP ID: ENSP00000433303
MGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLL

SEQ ID NO: 62549 - protein, 645 aa, Homo sapiens
  Payload ID: 12497
  Gene Symbol: PICALM
  Gene Name: phosphatidylinositol binding clathrin assembly protein
  Uniprot ID: Q13492
  ENSP ID: ENSP00000433846
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMAPPVMAYPATTPTGMIGYGIPPQMGSVPVMTQPTLIYSQPVMRPPNPFGPVSGAQIQFM

SEQ ID NO: 62550 - protein, 551 aa, Homo sapiens
  Payload ID: 12497
  Gene Symbol: PICALM
  Gene Name: phosphatidylinositol binding clathrin assembly protein
  Uniprot ID: Q13492
  ENSP ID: ENSP00000434884
MNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMAPPVMAYPATTPTGMIGYGIPPQMGSVPVMTQPTLIYSQPVMRPPNPFGPVSGAQIQFM

SEQ ID NO: 62551 - protein, 134 aa, Homo sapiens
  Payload ID: 12497
  Gene Symbol: PICALM
  Gene Name: phosphatidylinositol binding clathrin assembly protein
  ENSP ID: ENSP00000435311
  MOD_RES (1)..(1): Any amino acid
XNKSTNVIVDSGGGLLKPTVASQNQNLPVAKLPPSKLVSDDLDSSLANLVGNLGIGNGTTKNDVNWSQPGEKKLTGGSNWQPKVAPTTAWNAATMPPQMGSVPVMTQPTLIYSQPVMRPPNPFGPVSGAQIQFM

SEQ ID NO: 62552 - protein, 48 aa, Homo sapiens; identical to SEQ ID NO: 62547
  Payload ID: 12497
  Gene Symbol: PICALM
  Gene Name: phosphatidylinositol binding clathrin assembly protein
  ENSP ID: ENSP00000435499

SEQ ID NO: 62553 - protein, 302 aa, Homo sapiens
  Payload ID: 12497
  Gene Symbol: PICALM
  Gene Name: phosphatidylinositol binding clathrin assembly protein
  ENSP ID: ENSP00000435737
  MOD_RES (1)..(1): Any amino acid
XATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDPFSATVDAVDDAIPSLNPFLTKSSGDVHLSISSDVSTFTTRTPTHEMFVGFTPSPVAQPHPSAGLNVDFESVFGNKSTNVIVDSGGGLLKPTVASQNQNLPVAKLPPSKLVSDDLDSSLANLVGNLGIGNGTTKNDVNWSQPGEKKLTGGSNWQPKVAPTTAWNAATMAPPVMAYPATT

SEQ ID NO: 62554 - protein, 308 aa, Homo sapiens
  Payload ID: 12497
  Gene Symbol: PICALM
  Gene Name: phosphatidylinositol binding clathrin assembly protein
  ENSP ID: ENSP00000435807
  MOD_RES (1)..(1): Any amino acid
XATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGGFTPSPVAQPHPSAGLNVDFESVFGNKSTNVIVDSGGGLLKPTVASQNQNLPVAKLPPSKLVSDDLDSSLANLVGNLGIGNGTTKNDVNWSQPGEKKLTGGSNWQPKVAPTTAWNAATMNGMHFPQYAPPVMAYPATTPTGMIGYGIPPQMGSVPVMTQPTLIYSQPVMRPPNPFGPVSGAQIQFM

SEQ ID NO: 62555 - protein, 147 aa, Homo sapiens
  Payload ID: 12497
  Gene Symbol: PICALM
  Gene Name: phosphatidylinositol binding clathrin assembly protein
  ENSP ID: ENSP00000436508
MNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFM

SEQ ID NO: 62556 - protein, 215 aa, Homo sapiens
  Payload ID: 12497
  Gene Symbol: PICALM
  Gene Name: phosphatidylinositol binding clathrin assembly protein
  ENSP ID: ENSP00000436852
  MOD_RES (1)..(1): Any amino acid
XFVGFTPSPVAQPHPSAGLNVDFESVFGNKSTNVIVDSGGGLLKPTVASQNQNLPVAKLPPSKLVSDDLDSSLANLVGNLGIGNGTTKNDVNWSQPGEKKLTGGSNWQPKVAPTTAWNAATMNGMHFPQYAPPVMAYPATTPTGMIGYGIPPQMGSVPVMTQPTLIYSQPVMRPPNPFGPVSGAQLSAASSPSSHSPHRASGKDPFAELSLEDFL

SEQ ID NO: 62557 - protein, 610 aa, Homo sapiens
  Payload ID: 12497
  Gene Symbol: PICALM
  Gene Name: phosphatidylinositol binding clathrin assembly protein
  Uniprot ID: Q13492
  ENSP ID: ENSP00000436958
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMNGMHFPQYAPPVMAYPATTPTGMIGYGIPPQMGSVPVMTQPTLIYSQPVMRPPNPFGPVSGAQIQFM

SEQ ID NO: 62558 - protein, 105 aa, Homo sapiens; identical to SEQ ID NO: 62544
  Payload ID: 12497
  Gene Symbol: PICALM
  Gene Name: phosphatidylinositol binding clathrin assembly protein
  ENSP ID: ENSP00000487119

SEQ ID NO: 62559 - protein, 484 aa, Homo sapiens
  Payload ID: 12498
  Gene Symbol: PIGA
  Gene Name: phosphatidylinositol glycan anchor biosynthesis, class A
  Uniprot ID: P37287
  ENSP ID: ENSP00000369820
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRYIFVRERVTIIHSHSSFSAMAHDALFHAKTMGLQTVFTDHSLFGFADVSSVLTNKLLTVSLCDTNHIICVSYTSKENTVLRAALNPEIVSVIPNAVDPTDFTPDPFRRHDSITIVVVSRLVYRKGIDLLSGIIPELCQKYPDLNFIIGGEGPKRIILEEVRERYQLHDRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 62560 - protein, 484 aa, Homo sapiens; identical to SEQ ID NO: 62559
  Payload ID: 12498
  Gene Symbol: PIGA
  Gene Name: phosphatidylinositol glycan anchor biosynthesis, class A
  Uniprot ID: P37287
  ENSP ID: ENSP00000442653

SEQ ID NO: 62561 - protein, 51 aa, Homo sapiens
  Payload ID: 12498
  Gene Symbol: PIGA
  Gene Name: phosphatidylinositol glycan anchor biosynthesis, class A
  ENSP ID: ENSP00000488970
QGHIFLNTSLTEAFCMAIVEAASCGLQVYDRVSVEAVLPMDKRLDRLISHC

SEQ ID NO: 62562 - protein, 150 aa, Homo sapiens
  Payload ID: 12498
  Gene Symbol: PIGA
  Gene Name: phosphatidylinositol glycan anchor biosynthesis, class A
  ENSP ID: ENSP00000489083
MAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWT

SEQ ID NO: 62563 - protein, 152 aa, Homo sapiens
  Payload ID: 12498
  Gene Symbol: PIGA
  Gene Name: phosphatidylinositol glycan anchor biosynthesis, class A
  ENSP ID: ENSP00000489205
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRYIFVRERVTIIHSHSSFSAMAHDALFHAKTMGLQTVFT

SEQ ID NO: 62564 - protein, 118 aa, Homo sapiens
  Payload ID: 12498
  Gene Symbol: PIGA
  Gene Name: phosphatidylinositol glycan anchor biosynthesis, class A
  ENSP ID: ENSP00000489207
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRDRFA

SEQ ID NO: 62565 - protein, 99 aa, Homo sapiens
  Payload ID: 12498
  Gene Symbol: PIGA
  Gene Name: phosphatidylinositol glycan anchor biosynthesis, class A
  ENSP ID: ENSP00000489491
VTHAYGNRKGIRYLTSGLKVYYLPLKVMYNQSTATTLFHSLPLLRSLLDQISKSHWNVLSEREDKSKFSLSRLFGCLFPEPPLPSLFCSQSGFTSTLHV

SEQ ID NO: 62566 - protein, 315 aa, Homo sapiens
  Payload ID: 12498
  Gene Symbol: PIGA
  Gene Name: phosphatidylinositol glycan anchor biosynthesis, class A
  ENSP ID: ENSP00000489528
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 62567 - protein, 250 aa, Homo sapiens
  Payload ID: 12498
  Gene Symbol: PIGA
  Gene Name: phosphatidylinositol glycan anchor biosynthesis, class A
  ENSP ID: ENSP00000489540
MELTGIDLLSGIIPELCQKYPDLNFIIGGEGPKRIILEEVRERYQLHDRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 62568 - protein, 554 aa, Homo sapiens
  Payload ID: 12499
  Gene Symbol: PIGB
  Gene Name: phosphatidylinositol glycan anchor biosynthesis, class B
  Uniprot ID: Q92521
  ENSP ID: ENSP00000164305
MRRPLSKCGMEPGGGDASLTLHGLQNRSHGKIKLRKRKSTLYFNTQEKSARRRGDLLGENIYLLLFTIALRILNCFLVQTSFVPDEYWQSLEVSHHMVFNYGYLTWEWTERLRSYTYPLIFASIYKILHLLGKDSVQLLIWIPRLAQALLSAVADVRLYSLMKQLENQEVARWVFFCQLCSWFTWYCCTRTLTNTMETVLTIIALFYYPLEGSKSMNSVKYSSLVALAFIIRPTAVILWTPLLFRHFCQEPRKLDLILHHFLPVGFVTLSLSLMIDRIFFGQWTLVQFNFLKFNVLQNWGTFYGSHPWHWYFSQGFPVILGTHLPFFIHGCYLAPKRYRILLVTVLWTLLVYSMLSHKEFRFIYPVLPFCMVFCGYSLTHLKTWKKPALSFLFLSNLFLALYTGLVHQRGTLDVMSHIQKVCYNNPNKSSASIFIMMPCHSTPYYSHVHCPLPMRFLQCPPDLTGKSHYLDEADVFYLNPLNWLHREFHDDASLPTHLITFSILEEEISAFLISSNYKRTAVFFHTHLPEGRIGSHIYVYERKLKGKFNMKMKF

SEQ ID NO: 62569 - protein, 555 aa, Homo sapiens
  Payload ID: 12499
  Gene Symbol: PIGB
  Gene Name: phosphatidylinositol glycan anchor biosynthesis, class B
  ENSP ID: ENSP00000438963
MRRPLSKCGMEPGGGDASLTLHGLQNRSHGKIKLRKRKSTLYFNTQEKSARRRGDLLGENIYLLLFTIALRILNCFLVQTSFVPDEYWQSLEVSHHMVFNNYGYLTWEWTERLRSYTYPLIFASIYKILHLLGKDSVQLLIWIPRLAQALLSAVADVRLYSLMKQLENQEVARWVFFCQLCSWFTWYCCTRTLTNTMETVLTIIALFYYPLEGSKSMNSVKYSSLVALAFIIRPTAVILWTPLLFRHFCQEPRKLDLILHHFLPVGFVTLSLSLMIDRIFFGQWTLVQFNFLKFNVLQNWGTFYGSHPWHWYFSQGFPVILGTHLPFFIHGCYLAPKRYRILLVTVLWTLLVYSMLSHKEFRFIYPVLPFCMVFCGYSLTHLKTWKKPALSFLFLSNLFLALYTGLVHQRGTLDVMSHIQKVCYNNPNKSSASIFIMMPCHSTPYYSHVHCPLPMRFLQCPPDLTGKSHYLDEADVFYLNPLNWLHREFHDDASLPTHLITFSILEEEISAFLISSNYKRTAVFFHTHLPEGRIGSHIYVYERKLKGKFNMKMKF

SEQ ID NO: 62570 - protein, 88 aa, Homo sapiens
  Payload ID: 12499
  Gene Symbol: PIGB
  Gene Name: phosphatidylinositol glycan anchor biosynthesis, class B
  ENSP ID: ENSP00000455040
GCYLAPKRYRILLVTVLWTLLVYSMLSHKEFRFIYPVLPFCMVFCGYSLTHLKTWKKPALSFLFLSNLFLALYTGLVHQRAMFTAHFP

SEQ ID NO: 62571 - protein, 134 aa, Homo sapiens
  Payload ID: 12499
  Gene Symbol: PIGB
  Gene Name: phosphatidylinositol glycan anchor biosynthesis, class B
  ENSP ID: ENSP00000455943
MRRPLSKCGMEPGGGDASLTLHGLQNRSHGKIKLRKRKSTLYFNTQEKSARRRGVFLPVVLLVHMVLLYQNPYKHHGNCSHYNCSFLLSFGRFKVYEQCQILIPGGTCLHNSSHSCHSVDTFALQTFLSRTKKA

SEQ ID NO: 62572 - protein, 58 aa, Homo sapiens
  Payload ID: 12499
  Gene Symbol: PIGB
  Gene Name: phosphatidylinositol glycan anchor biosynthesis, class B
  ENSP ID: ENSP00000456285
MRRPLSKCGMEPGGGDASLTLHGLQNRSHGKIKLRKRKSTLYFNTQEKSARRRGDLDS

SEQ ID NO: 62573 - protein, 255 aa, Homo sapiens
  Payload ID: 12499
  Gene Symbol: PIGB
  Gene Name: phosphatidylinositol glycan anchor biosynthesis, class B
  ENSP ID: ENSP00000456531
MRRPLSKCGMEPGGGDASLTLHGLQNRSHGKIKLRKRKSTLYFNTQEKSARRRGDLLGENIYLLLFTIALRILNCFLVQTSFVPDEYWQSLEVSHHMVFKERLRSYTYPLIFASIYKILHLLGKDSVQLLIWIPRLAQALLSAVADVRLYSLMKQLENQEVARWVFFCQLCSWFTWYCCTRTLTNTMETVLTIIALFYYPLEGSKSMNSVKYSSLVALAFIIRPTAVILWTPLLFRHFCQEPRKLDLILHHFLPV

SEQ ID NO: 62574 - protein, 297 aa, Homo sapiens
  Payload ID: 12500
  Gene Symbol: PIGC
  Gene Name: phosphatidylinositol glycan anchor biosynthesis, class C
  Uniprot ID: Q92535
  ENSP ID: ENSP00000356701
MYAQPVTNTKEVKWQKVLYERQPFPDNYVDRRFLEELRKNIHARKYQYWAVVFESSVVIQQLCSVCVFVVIWWYMDEGLLAPHWLLGTGLASSLIGYVLFDLIDGGEGRKKSGQTRWADLKSALVFITFTYGFSPVLKTLTESVSTDTIYAMSVFMLLGHLIFFDYGANAAIVSSTLSLNMAIFASVCLASRLPRSLHAFIMVTFAIQIFALWPMLQKKLKACTPRSYVGVTLLFAFSAVGGLLSISAVGAVLFALLLMSISCLCPFYLIRLQLFKENIHGPWDEAEIKEDLSRFLS

SEQ ID NO: 62575 - protein, 297 aa, Homo sapiens; identical to SEQ ID NO: 62574
  Payload ID: 12500
  Gene Symbol: PIGC
  Gene Name: phosphatidylinositol glycan anchor biosynthesis, class C
  Uniprot ID: Q92535
  ENSP ID: ENSP00000356702

SEQ ID NO: 62576 - protein, 219 aa, Homo sapiens
  Payload ID: 12501
  Gene Symbol: PIGF
  Gene Name: phosphatidylinositol glycan anchor biosynthesis, class F
  Uniprot ID: Q07326
  ENSP ID: ENSP00000281382
MKDNDIKRLLYTHLLCIFSIILSVFIPSLFLENFSILETHLTWLCICSGFVTAVNLVLYLVVKPNTSSKRSSLSHKVTGFLKCCIYFLMSCFSFHVIFVLYGAPLIELALETFLFAVILSTFTTVPCLCLLGPNLKAWLRVFSRNGVTSIWENSLQITTISSFVGAWLGALPIPLDWERPWQVWPISCTLGATFGYVAGLVISPLWIYWNRKQLTYKNN

SEQ ID NO: 62577 - protein, 206 aa, Homo sapiens
  Payload ID: 12501
  Gene Symbol: PIGF
  Gene Name: phosphatidylinositol glycan anchor biosynthesis, class F
  Uniprot ID: Q07326
  ENSP ID: ENSP00000302663
MKDNDIKRLLYTHLLCIFSIILSVFIPSLFLENFSILETHLTWLCICSGFVTAVNLVLYLVVKPNTSSKRSSLSHKVTGFLKCCIYFLMSCFSFHVIFVLYGAPLIELALETFLFAVILSTFTTVPCLCLLGPNLKAWLRVFSRNGVTSIWENSLQITTISSFVGAWLGALPIPLDWERPWQMTVERKRSTYRSLHVPCRGLGTVK

SEQ ID NO: 62578 - protein, 57 aa, Homo sapiens
  Payload ID: 12501
  Gene Symbol: PIGF
  Gene Name: phosphatidylinositol glycan anchor biosynthesis, class F
  ENSP ID: ENSP00000410361
LGPNLKAWLRVFSRNGVTSIWENSLQITTISSFVGAWLGALPIPLDWERPWQKQIAR

SEQ ID NO: 62579 - protein, 112 aa, Homo sapiens
  Payload ID: 12501
  Gene Symbol: PIGF
  Gene Name: phosphatidylinositol glycan anchor biosynthesis, class F
  ENSP ID: ENSP00000413202
MKDNDIKRLLYTHLLCIFSIILSVFIPSLFLENFSILETHLTWLCICSGFVTAVNLVLYLVVKPNTSSKRSSLSHKVGIGNIFICSYFVYFYYCALLMFVRTKPQSMAKSVQ

SEQ ID NO: 62580 - protein, 49 aa, Homo sapiens
  Payload ID: 12501
  Gene Symbol: PIGF
  Gene Name: phosphatidylinositol glycan anchor biosynthesis, class F
  ENSP ID: ENSP00000429355
MKDNDIKRLLYTHLLCIFSIILSVFIPSLFLENFSILETHLTWLCICSG

SEQ ID NO: 62581 - protein, 975 aa, Homo sapiens
  Payload ID: 12502
  Gene Symbol: PIGG
  Gene Name: phosphatidylinositol glycan anchor biosynthesis, class G
  Uniprot ID: Q5H8A4
  ENSP ID: ENSP00000311750
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQGNSNNIATVDISAGFVGLDTYVEIPAVLLTAFGTYAGPVLWASHLVHFLSSETRSGSALSHACFCYALICSIPVFTYIVLVTSLRYHLFIWSVFSPKLLYEGMHLLITAAVCVFFTAMDQTRLTQS

SEQ ID NO: 62582 - protein, 850 aa, Homo sapiens
  Payload ID: 12502
  Gene Symbol: PIGG
  Gene Name: phosphatidylinositol glycan anchor biosynthesis, class G
  Uniprot ID: Q5H8A4
  ENSP ID: ENSP00000372494
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVGTVVVLEVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQGNSNNIATVDISAGFVGLDTYVEIPAVLLTAFGTYAGPVLWASHLVHFLSSETRSGSALSHACFCYALICSIPVFTYIVLVTSLRYHLFIWSVFSPKLLYEGMHLLITAAVCVFFTAMDQTRLTQS

SEQ ID NO: 62583 - protein, 983 aa, Homo sapiens
  Payload ID: 12502
  Gene Symbol: PIGG
  Gene Name: phosphatidylinositol glycan anchor biosynthesis, class G
  Uniprot ID: Q5H8A4
  ENSP ID: ENSP00000415203
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVGTVVVLEVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQGNSNNIATVDISAGFVGLDTYVEIPAVLLTAFGTYAGPVLWASHLVHFLSSETRSGSALSHACFCYALICSIPVFTYIVLVTSLRYHLFIWSVFSPKLLYEGMHLLITAAVCVFFTAMDQTRLTQS

SEQ ID NO: 62584 - protein, 480 aa, Homo sapiens
  Payload ID: 12502
  Gene Symbol: PIGG
  Gene Name: phosphatidylinositol glycan anchor biosynthesis, class G
  ENSP ID: ENSP00000421550
MPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVGTVVVLEVLTLLLLSVPQALRRKAELEVPLSSPGFSLLFYLVILVLSAVHVIVCTSAESSCYFCGLSWLAAGGVMVLASALLCVIVSVLTNVLVGGNTPRKVRTAGSWECDVVLLLRLFLLFQAAFRLPDSG

SEQ ID NO: 62585 - protein, 24 aa, Homo sapiens
  Payload ID: 12502
  Gene Symbol: PIGG
  Gene Name: phosphatidylinositol glycan anchor biosynthesis, class G
  ENSP ID: ENSP00000422410
MTKFIWKPLRHDAAEITVMHYWFG

SEQ ID NO: 62586 - protein, 193 aa, Homo sapiens
  Payload ID: 12502
  Gene Symbol: PIGG
  Gene Name: phosphatidylinositol glycan anchor biosynthesis, class G
  ENSP ID: ENSP00000423596
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEKSM

SEQ ID NO: 62587 - protein, 463 aa, Homo sapiens
  Payload ID: 12502
  Gene Symbol: PIGG
  Gene Name: phosphatidylinositol glycan anchor biosynthesis, class G
  ENSP ID: ENSP00000424619
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQFSPCSCSASHRHCAERLSWKSHCHLLGFLCSFIW

SEQ ID NO: 62588 - protein, 894 aa, Homo sapiens
  Payload ID: 12502
  Gene Symbol: PIGG
  Gene Name: phosphatidylinositol glycan anchor biosynthesis, class G
  ENSP ID: ENSP00000424800
MPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVGTVVVLEVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQGNSNNIATVDISAGFVGLDTYVEIPAVLLTAFGTYAGPVLWASHLVHFLSSETRSGSALSHACFCYALICSIPVFTYIVLVTSLRYHLFIWSVFSPKLLYEGMHLLITAAVCVFFTAMDQTRLTQS

SEQ ID NO: 62589 - protein, 299 aa, Homo sapiens
  Payload ID: 12502
  Gene Symbol: PIGG
  Gene Name: phosphatidylinositol glycan anchor biosynthesis, class G
  Uniprot ID: Q5H8A4
  ENSP ID: ENSP00000426002
MPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKGSHPAPAQRPTGTAQKG

SEQ ID NO: 62590 - protein, 186 aa, Homo sapiens
  Payload ID: 12502
  Gene Symbol: PIGG
  Gene Name: phosphatidylinositol glycan anchor biosynthesis, class G
  ENSP ID: ENSP00000427069
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKVSSLLTAALKYIVHFPRTVGKEKSIDDGEPSWLCRRHQEPQFSCTAGRQCDKTSKSSWKKNSLLWR

SEQ ID NO: 62591 - protein, 188 aa, Homo sapiens
  Payload ID: 12503
  Gene Symbol: PIGH
  Gene Name: phosphatidylinositol glycan anchor biosynthesis, class H
  Uniprot ID: Q14442
  ENSP ID: ENSP00000216452
MEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMQKVIYYLCILLKDPVEPHGISQVVPVFQSAKPRLDCLIEVYRSCQEILAHQKATSTSP

SEQ ID NO: 62592 - protein, 136 aa, Homo sapiens
  Payload ID: 12503
  Gene Symbol: PIGH
  Gene Name: phosphatidylinositol glycan anchor biosynthesis, class H
  ENSP ID: ENSP00000452816
  MOD_RES (1)..(1): Any amino acid
XLLGLLGYLHFVKIDQETLLIIDSLGIQMTSSYASGKESTTFIEMGKVKDIVINEAIYMQKVIYYLCILLKDPVEPHGISQVVPVFQRQSLTLSPRLECSDNHHSLQPPPPRLKKSSCLSLLRTWDYRVPSPGWTA

SEQ ID NO: 62593 - protein, 83 aa, Homo sapiens
  Payload ID: 12503
  Gene Symbol: PIGH
  Gene Name: phosphatidylinositol glycan anchor biosynthesis, class H
  ENSP ID: ENSP00000452924
MEDERSFSDICGGRLALQRRYYSPSCREFCLSCPRLSLRSLTAVTCTVWLAAYGLFTLCEHDPLCCHLHHPLRSAWLSPFCED

SEQ ID NO: 62594 - protein, 133 aa, Homo sapiens
  Payload ID: 12503
  Gene Symbol: PIGH
  Gene Name: phosphatidylinositol glycan anchor biosynthesis, class H
  ENSP ID: ENSP00000452974
MEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMVSI

SEQ ID NO: 62595 - protein, 137 aa, Homo sapiens
  Payload ID: 12503
  Gene Symbol: PIGH
  Gene Name: phosphatidylinositol glycan anchor biosynthesis, class H
  ENSP ID: ENSP00000452996
MEDERSFSDICGGRLALQRRYYSPSCREFCLSCPRLSLRSLTAVTCTVWLAAYGLFTLCENSMILSAAIFITLLGKESTTFIEMGKVKDIVINEAIYMQKVIYYLCILLKDPVEPHGISQVVPVFQRQSLTLSPRLE

SEQ ID NO: 62596 - protein, 137 aa, Homo sapiens
  Payload ID: 12503
  Gene Symbol: PIGH
  Gene Name: phosphatidylinositol glycan anchor biosynthesis, class H
  ENSP ID: ENSP00000453158
  MOD_RES (1)..(1): Any amino acid
XSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMSAKPRLDCLIEVYRSCQEILAHQKATSTSP

SEQ ID NO: 62597 - protein, 187 aa, Homo sapiens
  Payload ID: 12503
  Gene Symbol: PIGH
  Gene Name: phosphatidylinositol glycan anchor biosynthesis, class H
  ENSP ID: ENSP00000453394
MEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMKVIYYLCILLKDPVEPHGISQVVPVFQSAKPRLDCLIEVYRSCQEILAHQKATSTSP

SEQ ID NO: 62598 - protein, 183 aa, Homo sapiens
  Payload ID: 12503
  Gene Symbol: PIGH
  Gene Name: phosphatidylinositol glycan anchor biosynthesis, class H
  ENSP ID: ENSP00000453733
MEDERSFSDICGGRLALQRRYYSPSCREFCLSCPRLSLRSLTAVTCTVWLAAYGLFTLCEMTSSYASGKESTTFIEMGKVKDIVINEAIYMQKVIYYLCILLKDPVEPHGISQVVPVFQRQSLTLSPRLECSDNHHSLQPPPPRLKKSSCLSLLRTWDYRCAPSRLANFFFLFLVEMRSCHVA

SEQ ID NO: 62599 - protein, 182 aa, Homo sapiens
  Payload ID: 12503
  Gene Symbol: PIGH
  Gene Name: phosphatidylinositol glycan anchor biosynthesis, class H
  ENSP ID: ENSP00000453759
  MOD_RES (1)..(1): Any amino acid
XGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMQKVIYYLCILLKDPVEPHGISQVVPVFQAAWCIHSKLATRPSCFLNRTLPGPSGQPSQEPIPC

SEQ ID NO: 62600 - protein, 83 aa, Homo sapiens; identical to SEQ ID NO: 62593
  Payload ID: 12503
  Gene Symbol: PIGH
  Gene Name: phosphatidylinositol glycan anchor biosynthesis, class H
  ENSP ID: ENSP00000454061

SEQ ID NO: 62601 - protein, 332 aa, Homo sapiens
  Payload ID: 12504
  Gene Symbol: PIGK
  Gene Name: phosphatidylinositol glycan anchor biosynthesis, class K
  ENSP ID: ENSP00000352041
MAVTDSLSRAATVLATVLLLSFGSVAASHIEDQAEQFFRSGHTNNWAVLVCTSRFWFNYRHVANTLSVYRSVKRLGIPDSHIVLMLADDMACNPRNPKPATVFSHKNMELNVYGDDVEVDYRSYEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESRYSS

SEQ ID NO: 62602 - protein, 395 aa, Homo sapiens
  Payload ID: 12504
  Gene Symbol: PIGK
  Gene Name: phosphatidylinositol glycan anchor biosynthesis, class K
  Uniprot ID: Q92643
  ENSP ID: ENSP00000359848
MAVTDSLSRAATVLATVLLLSFGSVAASHIEDQAEQFFRSGHTNNWAVLVCTSRFWFNYRHVANTLSVYRSVKRLGIPDSHIVLMLADDMACNPRNPKPATVFSHKNMELNVYGDDVEVDYRSYEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESSYKEDQMDEKLMEPLKYAEQLPVAQIIHQKPKLKDWHPPGGFILGLWALIIMVFFKTYGIKHMKFIF

SEQ ID NO: 62603 - protein, 301 aa, Homo sapiens
  Payload ID: 12504
  Gene Symbol: PIGK
  Gene Name: phosphatidylinositol glycan anchor biosynthesis, class K
  ENSP ID: ENSP00000388854
MAVTDSLSRAATVLATVLLLSFGSVAASHIEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESSYKEDQMDEKLMEPLKYAEQLPVAQIIHQKPKLKDWHPPGGFILGLWALIIMVFFKTYGIKHMKFIF

SEQ ID NO: 62604 - protein, 27 aa, Homo sapiens
  Payload ID: 12504
  Gene Symbol: PIGK
  Gene Name: phosphatidylinositol glycan anchor biosynthesis, class K
  ENSP ID: ENSP00000474518
KNMELNVYGDDVEVDYRSYEGMVEMVS

SEQ ID NO: 62605 - protein, 252 aa, Homo sapiens
  Payload ID: 12505
  Gene Symbol: PIGL
  Gene Name: phosphatidylinositol glycan anchor biosynthesis, class L
  Uniprot ID: Q9Y2B2
  ENSP ID: ENSP00000225609
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRALHSEGKLPKGCSVLTLQSVNVLRKYISLLDLPLSLLHTQDVLFVLNSKEVAQAKKAMSCHRSQLLWFRRLYIIFSRYMRINSLSFL

SEQ ID NO: 62606 - protein, 244 aa, Homo sapiens
  Payload ID: 12505
  Gene Symbol: PIGL
  Gene Name: phosphatidylinositol glycan anchor biosynthesis, class L
  ENSP ID: ENSP00000379185
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRVLCAHASVCECAAQVHLPSGSALVSASYAGCPLRAQQQRSGTGQESHVLPPQPAPLVPPPLHYLLPVHENQLTELPLKP

SEQ ID NO: 62607 - protein, 150 aa, Homo sapiens
  Payload ID: 12505
  Gene Symbol: PIGL
  Gene Name: phosphatidylinositol glycan anchor biosynthesis, class L
  ENSP ID: ENSP00000462432
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLKDRANSRL

SEQ ID NO: 62608 - protein, 188 aa, Homo sapiens
  Payload ID: 12505
  Gene Symbol: PIGL
  Gene Name: phosphatidylinositol glycan anchor biosynthesis, class L
  ENSP ID: ENSP00000463540
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRALHSEGKLPKESCPQPSRGSGWG

SEQ ID NO: 62609 - protein, 145 aa, Homo sapiens
  Payload ID: 12505
  Gene Symbol: PIGL
  Gene Name: phosphatidylinositol glycan anchor biosynthesis, class L
  ENSP ID: ENSP00000463754
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRLSYLRLMCLSEAQGPQQHTPVSQSSDYSSLGMG

SEQ ID NO: 62610 - protein, 101 aa, Homo sapiens
  Payload ID: 12505
  Gene Symbol: PIGL
  Gene Name: phosphatidylinositol glycan anchor biosynthesis, class L
  ENSP ID: ENSP00000464424
MEAMWLLCVALAVLAWGFLWVWDSSERMKSREQGGRLGAESRTLLVIAHPDDEAMFFAPTVLGLARLRHWVYLLCFSAGISQMTQACSGTQSTWPESSFST

SEQ ID NO: 62611 - protein, 102 aa, Homo sapiens
  Payload ID: 12505
  Gene Symbol: PIGL
  Gene Name: phosphatidylinositol glycan anchor biosynthesis, class L
  ENSP ID: ENSP00000470064
VVTFDAGGVSGHSNHIALYAAVRVLCAHASVCECAAQVHLPSGSALVSASYAGCPLRAQQQRSGTGQESHVLPPQPAPLVPPPLHYLLPVHENQLTELPLKP

SEQ ID NO: 62612 - protein, 92 aa, Homo sapiens
  Payload ID: 12505
  Gene Symbol: PIGL
  Gene Name: phosphatidylinositol glycan anchor biosynthesis, class L
  ENSP ID: ENSP00000485657
  MOD_RES (1)..(1): Any amino acid
XCVALAVLAWGFLWVWDSSERMKSREQGGRLGAESRTLLVIAHPDDEAMFFAPTVLGLARLRHWVYLLCFSAVFRRELSEYTEGLTSEPLTA

SEQ ID NO: 62613 - protein, 423 aa, Homo sapiens [sequence omitted]

SEQ ID NO: 62614 - protein, 931 aa, Homo sapiens
  Payload ID: 12507
  Gene Symbol: PIGN
  Gene Name: phosphatidylinositol glycan anchor biosynthesis, class N
  Uniprot ID: O95427
  ENSP ID: ENSP00000350263
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHHARNNQSLFSKINEEKIVFFLHLLGIDTNGHAHRPSSRDYKHNIKKVDDGVKEIVSMFNHFYGNDGKTTFIFTSDHGMTDWGSHGAGHPSETLTPLVTWGAGIKYPQRVSAQQFDDAFLKEWRLENWKRLDVNQADIAPLMTSLIGVPFPLNSVGILPVDYLNNTDLFKAESMFTNAVQILEQFKVKMTQKKEVTLPFLFTPFKLLSDSKQFNILRKARSYIKHRKFDEVVSLCKELIHLALKGLSYYHTYDRFFLGVNVVIGFVGWISYASLLIIKSHSNLIKGVSKEVKKPSHLLPCSFVAIGILVAFFLLIQACPWTYYVYGLLPLPIWYAVLREFQVIQDLVVSVLTYPLSHFVGYLLAFTLGIEVLVLSFFYRYMLTAGLTAFAAWPFLTRLWTRAKMTSLSWTFFSLLLAVFPLMPVVGRKPDISLVMGAGLLVLLLSLCVVTSLMKRKDSFIKEELLVHLLQVLSTVLSMYVVYSTQSSLLRKQGLPLMNQIISWATLASSLVVPLLSSPVLFQRLFSILLSLMSTYLLLSTGYEALFPLVLSCLMFVWINIEQETLQQSGVCCKQKLTSIQFSYNTDITQFRQLYLDDIRRAFFLVFFLVTAFFGTGNIASINSFDLASVYCFLTVFSPFMMGALMMWKILIPFVLVMCAFEAVQLTTQLSSKSLFLIVLVISDIMALHFFFLVKDYGSWLDIGTSISHYVIVMSMTIFLVFLNGLAQLLTTKKLRLCGKPKSHFM

SEQ ID NO: 62615 - protein, 931 aa, Homo sapiens; identical to SEQ ID NO: 62614
  Payload ID: 12507
  Gene Symbol: PIGN
  Gene Name: phosphatidylinositol glycan anchor biosynthesis, class N
  Uniprot ID: O95427
  ENSP ID: ENSP00000383188

SEQ ID NO: 62616 - protein, 140 aa, Homo sapiens
  Payload ID: 12507
  Gene Symbol: PIGN
  Gene Name: phosphatidylinositol glycan anchor biosynthesis, class N
  ENSP ID: ENSP00000464707
MMINLEARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDT

SEQ ID NO: 62617 - protein, 143 aa, Homo sapiens
  Payload ID: 12507
  Gene Symbol: PIGN
  Gene Name: phosphatidylinositol glycan anchor biosynthesis, class N
  ENSP ID: ENSP00000465241
  MOD_RES (1)..(1): Any amino acid
XPCSFVAIGILVAFFLLIQACPWTYYVYGLLPLPIWYAVLREFQVIQDLVVSVLTYPLSHFVGYLLAFTLGIEVLVLSFFYRYMLTAGLTAFAAWPFLTRLWTRAKMTSLSWTFFSLLLAVFPLMPVVGRKPDISLVILKECI

SEQ ID NO: 62618 - protein, 93 aa, Homo sapiens
  Payload ID: 12507
  Gene Symbol: PIGN
  Gene Name: phosphatidylinositol glycan anchor biosynthesis, class N
  ENSP ID: ENSP00000465506
MLLFFTLGLLIHFVFFASIFDIYFTSPLVHGMTPQFTPLPPPARRLVLFVADGLRADALYELDENGNSRAPFIRNIIMHEGSWGISHTRVPTE

SEQ ID NO: 62619 - protein, 88 aa, Homo sapiens
  Payload ID: 12507
  Gene Symbol: PIGN
  Gene Name: phosphatidylinositol glycan anchor biosynthesis, class N
  ENSP ID: ENSP00000465897
MLLFFTLGLLIHFVFFASIFDIYFTSPLVHGMTPQFTPLPPPARRLVLFVADGLRADALYELDENGNSRAPFIRNIIMHEGSWGISHT

SEQ ID NO: 62620 - protein, 116 aa, Homo sapiens
  Payload ID: 12507
  Gene Symbol: PIGN
  Gene Name: phosphatidylinositol glycan anchor biosynthesis, class N
  ENSP ID: ENSP00000466035
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGW

SEQ ID NO: 62621 - protein, 33 aa, Homo sapiens
  Payload ID: 12507
  Gene Symbol: PIGN
  Gene Name: phosphatidylinositol glycan anchor biosynthesis, class N
  ENSP ID: ENSP00000466354
MLLFFTLGLLIHFVFFASIFDIYFTSPLVHGMT

SEQ ID NO: 62622 - protein, 122 aa, Homo sapiens
  Payload ID: 12507
  Gene Symbol: PIGN
  Gene Name: phosphatidylinositol glycan anchor biosynthesis, class N
  ENSP ID: ENSP00000466462
MHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHHARNNQSLFSKI

SEQ ID NO: 62623 - protein, 84 aa, Homo sapiens
  Payload ID: 12507
  Gene Symbol: PIGN
  Gene Name: phosphatidylinositol glycan anchor biosynthesis, class N
  ENSP ID: ENSP00000466883
MHEGSWGISHTRVPTESRPGHVALIAGFYEDVSAVAKGWKENPVEFDSLFNESKYTWSWGSPDILPMFAKGASGDHVYTYSYDA

SEQ ID NO: 62624 - protein, 29 aa, Homo sapiens
  Payload ID: 12507
  Gene Symbol: PIGN
  Gene Name: phosphatidylinositol glycan anchor biosynthesis, class N
  ENSP ID: ENSP00000466985
  MOD_RES (1)..(1): Any amino acid
XIRGFLIMLRNRYKRTCSSTILERLQAQY

SEQ ID NO: 62625 - protein, 111 aa, Homo sapiens
  Payload ID: 12507
  Gene Symbol: PIGN
  Gene Name: phosphatidylinositol glycan anchor biosynthesis, class N
  ENSP ID: ENSP00000467410
QKKEVTLPFLFTPFKFQVIQDLVVSVLTYPLSHFVGYLLAFTLGIEVLVLSFFYRYMLTAGLTAFAAWPFLTRLWTRAKMTSLSWTFFSLLLAVFPLMPVVGRKPDISLVM

SEQ ID NO: 62626 - protein, 183 aa, Homo sapiens
  Payload ID: 12507
  Gene Symbol: PIGN
  Gene Name: phosphatidylinositol glycan anchor biosynthesis, class N
  ENSP ID: ENSP00000467458
MHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHHARNNQSLFSKINEEKIVFFLHLLGIDTNGHAHRPSSRDYKHNIKKVDDGVKEIVSMFNHFYGNDGKTTFIFT

SEQ ID NO: 62627 - protein, 103 aa, Homo sapiens
  Payload ID: 12507
  Gene Symbol: PIGN
  Gene Name: phosphatidylinositol glycan anchor biosynthesis, class N
  ENSP ID: ENSP00000467618
PGHVALIAGFYEDVSAVAKGWKENPVEFDSLFNESKYTWSWGSPDILPMFAKGASGDHVYTYSYDAKREDFGAQDATKLDTWVFDNVKVCAIEWLIYKKHIFT

SEQ ID NO: 62628 - protein, 192 aa, Homo sapiens
  Payload ID: 12507
  Gene Symbol: PIGN
  Gene Name: phosphatidylinositol glycan anchor biosynthesis, class N
  ENSP ID: ENSP00000467812
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHHARNN

SEQ ID NO: 62629 - protein, 83 aa, Homo sapiens
  Payload ID: 12507
  Gene Symbol: PIGN
  Gene Name: phosphatidylinositol glycan anchor biosynthesis, class N
  ENSP ID: ENSP00000468456
MLLFFTLGLLIHFVFFASIFDIYFTSPLVHGMTPQFTPLPPPARRLVLFVADGLRADALYELDENGNSRAPFIRNIIMHEGSW

SEQ ID NO: 62630 - protein, 188 aa, Homo sapiens
  Payload ID: 12507
  Gene Symbol: PIGN
  Gene Name: phosphatidylinositol glycan anchor biosynthesis, class N
  ENSP ID: ENSP00000468721
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHH

SEQ ID NO: 62631 - protein, 672 aa, Homo sapiens
  Payload ID: 12508
  Gene Symbol: PIGO
  Gene Name: phosphatidylinositol glycan anchor biosynthesis, class O
  Uniprot ID: Q8TEQ8
  ENSP ID: ENSP00000298004
MQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 62632 - protein, 672 aa, Homo sapiens; identical to SEQ ID NO: 62631
  Payload ID: 12508
  Gene Symbol: PIGO
  Gene Name: phosphatidylinositol glycan anchor biosynthesis, class O
  Uniprot ID: Q8TEQ8
  ENSP ID: ENSP00000354678

SEQ ID NO: 62633 - protein, 1089 aa, Homo sapiens
  Payload ID: 12508
  Gene Symbol: PIGO
  Gene Name: phosphatidylinositol glycan anchor biosynthesis, class O
  Uniprot ID: Q8TEQ8
  ENSP ID: ENSP00000367880
MQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 62634 - protein, 134 aa, Homo sapiens
  Payload ID: 12509
  Gene Symbol: PIGP
  Gene Name: phosphatidylinositol glycan anchor biosynthesis, class P
  Uniprot ID: P57054
  ENSP ID: ENSP00000353719
MVENSPSPLPERAIYGFVLFLSSQFGFILYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 62635 - protein, 108 aa, Homo sapiens
  Payload ID: 12509
  Gene Symbol: PIGP
  Gene Name: phosphatidylinositol glycan anchor biosynthesis, class P
  Uniprot ID: P57054
  ENSP ID: ENSP00000382049
MVLYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 62636 - protein, 134 aa, Homo sapiens; identical to SEQ ID NO: 62634
  Payload ID: 12509
  Gene Symbol: PIGP
  Gene Name: phosphatidylinositol glycan anchor biosynthesis, class P
  Uniprot ID: P57054
  ENSP ID: ENSP00000382053

SEQ ID NO: 62637 - protein, 134 aa, Homo sapiens; identical to SEQ ID NO: 62634
  Payload ID: 12509
  Gene Symbol: PIGP
  Gene Name: phosphatidylinositol glycan anchor biosynthesis, class P
  Uniprot ID: P57054
  ENSP ID: ENSP00000382054

SEQ ID NO: 62638 - protein, 25 aa, Homo sapiens
  Payload ID: 12509
  Gene Symbol: PIGP
  Gene Name: phosphatidylinositol glycan anchor biosynthesis, class P
  ENSP ID: ENSP00000388372
MVLYLVWAFIPESWLNSLGLTYWPQ

SEQ ID NO: 62639 - protein, 158 aa, Homo sapiens
  Payload ID: 12509
  Gene Symbol: PIGP
  Gene Name: phosphatidylinositol glycan anchor biosynthesis, class P
  ENSP ID: ENSP00000420037
MVPRSTSLTLIVFLFHRLSKAPGKMVENSPSPLPERAIYGFVLFLSSQFGFILYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 62640 - protein, 760 aa, Homo sapiens
  Payload ID: 12510
  Gene Symbol: PIGQ
  Gene Name: phosphatidylinositol glycan anchor biosynthesis, class Q
  Uniprot ID: Q9BRB3
  ENSP ID: ENSP00000026218
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLADKPTALQPRGAHLPPPQLWLPPQALLGRPVPQAVPWGAHLPLEAERGQAGLRELLARLAPPHGHSQPSALPGWHQLSWRMSCALWTLLCAPEHGRPCYHTLGLEVIGSEQMWGWPARLAALHHWHCLPWDPLPTCCGHHGGEHSNPRCPEHCPMPTLCTQVQRVRPPQQPQVEGWSPWGLPSGSALAVGVEGPCQDEPPSPRHPLAPSAEQHPASGGLKQSLTPVPSGPGPSLPEPHGVYLRMFPGEVAL

SEQ ID NO: 62641 - protein, 148 aa, Homo sapiens
  Payload ID: 12510
  Gene Symbol: PIGQ
  Gene Name: phosphatidylinositol glycan anchor biosynthesis, class Q
  ENSP ID: ENSP00000293874
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLP

SEQ ID NO: 62642 - protein, 581 aa, Homo sapiens
  Payload ID: 12510
  Gene Symbol: PIGQ
  Gene Name: phosphatidylinositol glycan anchor biosynthesis, class Q
  Uniprot ID: Q9BRB3
  ENSP ID: ENSP00000326674
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLAAGVKFRVLRHEAGRPLRLLMQINPLPYSRVVHTYRLPSCGCHPKHSWGALCRKLFLGELIYPWRQRGDKQD

SEQ ID NO: 62643 - protein, 581 aa, Homo sapiens; identical to SEQ ID NO: 62642
  Payload ID: 12510
  Gene Symbol: PIGQ
  Gene Name: phosphatidylinositol glycan anchor biosynthesis, class Q
  Uniprot ID: Q9BRB3
  ENSP ID: ENSP00000386760

SEQ ID NO: 62644 - protein, 111 aa, Homo sapiens
  Payload ID: 12510
  Gene Symbol: PIGQ
  Gene Name: phosphatidylinositol glycan anchor biosynthesis, class Q
  ENSP ID: ENSP00000387820
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATH

SEQ ID NO: 62645 - protein, 238 aa, Homo sapiens
  Payload ID: 12510
  Gene Symbol: PIGQ
  Gene Name: phosphatidylinositol glycan anchor biosynthesis, class Q
  ENSP ID: ENSP00000409341
  MOD_RES (1)..(1): Any amino acid
XLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLAGSEPWRPEATGLCSSALGFSGLGSLNCRPGAKRGKVRGTRSQQGGHHPLA

SEQ ID NO: 62646 - protein, 574 aa, Homo sapiens
  Payload ID: 12510
  Gene Symbol: PIGQ
  Gene Name: phosphatidylinositol glycan anchor biosynthesis, class Q
  ENSP ID: ENSP00000410434
MWWALRPPGILPPGMVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLAGSEPWRPEATGLCSSALGFSGLGSLNCRPGAKRGKVRGTRSQQGGHHPLA

SEQ ID NO: 62647 - protein, 396 aa, Homo sapiens
  Payload ID: 12510
  Gene Symbol: PIGQ
  Gene Name: phosphatidylinositol glycan anchor biosynthesis, class Q
  ENSP ID: ENSP00000413753
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADVSGLGWSPVSRVGVGTPPGQQSLPGPEPPPHKASSTFSMLWRHGPPLNQKQELQGRWGLGRAGLAGTPPFPSEGAVCRSQPG

SEQ ID NO: 62648 - protein, 139 aa, Homo sapiens
  Payload ID: 12510
  Gene Symbol: PIGQ
  Gene Name: phosphatidylinositol glycan anchor biosynthesis, class Q
  ENSP ID: ENSP00000439374
GLSSLWRLFRGKKWNVLRQRVDSCSYDLDQLRLLVVAVQGLIHLLVDLINSLPLYSLGLRLCRPYRLAAGVKFRVLRHEAGRPLRLLMQINPLPYSRVVHTYRLPSCGCHPKHSWGALCRKLFLGELIYPWRQRGDKQD

SEQ ID NO: 62649 - protein, 299 aa, Homo sapiens
  Payload ID: 12510
  Gene Symbol: PIGQ
  Gene Name: phosphatidylinositol glycan anchor biosynthesis, class Q
  Uniprot ID: Q9BRB3
  ENSP ID: ENSP00000439650
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRCGPALVSAGLGACPLAPSPSPSAPR

SEQ ID NO: 62650 - protein, 103 aa, Homo sapiens
  Payload ID: 12510
  Gene Symbol: PIGQ
  Gene Name: phosphatidylinositol glycan anchor biosynthesis, class Q
  ENSP ID: ENSP00000489216
  MOD_RES (1)..(1): Any amino acid
XVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLA

SEQ ID NO: 62651 - protein, 41 aa, Homo sapiens
  Payload ID: 12511
  Gene Symbol: PIGS
  Gene Name: phosphatidylinositol glycan anchor biosynthesis, class S
  ENSP ID: ENSP00000268758
MAAAGAAATHLAPPHGACHCRVYAGVSAPGRPGEAALHRCA

SEQ ID NO: 62652 - protein, 555 aa, Homo sapiens
  Payload ID: 12511
  Gene Symbol: PIGS
  Gene Name: phosphatidylinositol glycan anchor biosynthesis, class S
  Uniprot ID: Q96S52
  ENSP ID: ENSP00000309430
MAAAGAAATHLEVARGKRAALFFAAVAIVLGLPLWWKTTETYRASLPYSQISGLNALQLRLMVPVTVVFTRESVPLDDQEKLPFTVVHEREIPLKYKMKIKCRFQKAYRRALDHEEEALSSGSVQEAEAMLDEPQEQAEGSLTVYVISEHSSLLPQDMMSYIGPKRTAVVRGIMHREAFNIIGRRIVQVAQAMSLTEDVLAAALADHLPEDKWSAEKRRPLKSSLGYEITFSLLNPDPKSHDVYWDIEGAVRRYVQPFLNALGAAGNFSVDSQILYYAMLGVNPRFDSASSSYYLDMHSLPHVINPVESRLGSSAASLYPVLNFLLYVPELAHSPLYIQDKDGAPVATNAFHSPRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 62653 - protein, 547 aa, Homo sapiens
  Payload ID: 12511
  Gene Symbol: PIGS
  Gene Name: phosphatidylinositol glycan anchor biosynthesis, class S
  Uniprot ID: Q96S52
  ENSP ID: ENSP00000378755
MPSEVARGKRAALFFAAVAIVLGLPLWWKTTETYRASLPYSQISGLNALQLRLMVPVTVVFTRESVPLDDQEKLPFTVVHEREIPLKYKMKIKCRFQKAYRRALDHEEEALSSGSVQEAEAMLDEPQEQAEGSLTVYVISEHSSLLPQDMMSYIGPKRTAVVRGIMHREAFNIIGRRIVQVAQAMSLTEDVLAAALADHLPEDKWSAEKRRPLKSSLGYEITFSLLNPDPKSHDVYWDIEGAVRRYVQPFLNALGAAGNFSVDSQILYYAMLGVNPRFDSASSSYYLDMHSLPHVINPVESRLGSSAASLYPVLNFLLYVPELAHSPLYIQDKDGAPVATNAFHSPRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 62654 - protein, 41 aa, Homo sapiens; identical to SEQ ID NO: 62651
  Payload ID: 12511
  Gene Symbol: PIGS
  Gene Name: phosphatidylinositol glycan anchor biosynthesis, class S
  ENSP ID: ENSP00000463406

SEQ ID NO: 62655 - protein, 116 aa, Homo sapiens
  Payload ID: 12511
  Gene Symbol: PIGS
  Gene Name: phosphatidylinositol glycan anchor biosynthesis, class S
  ENSP ID: ENSP00000466846
MAAAGAAATHLEVARGKRAALFFAAVAIVLGLPLWWKTTETYRASLPYSQISGLNALQVRLLCGRVGGQPPRQGGDSVTALMLLPVAPPHGACHCRVYAGVSAPGRPGEAALHRCA

SEQ ID NO: 62656 - protein, 476 aa, Homo sapiens
  Payload ID: 12512
  Gene Symbol: PIGT
  Gene Name: phosphatidylinositol glycan anchor biosynthesis, class T
  Uniprot ID: Q969N2
  ENSP ID: ENSP00000279035
MAAAMPLALLVLLLLGPGGWCLAEPPRDSLREELVITPLPSGDVAATFQFRTRWDSELQREGDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 62657 - protein, 578 aa, Homo sapiens
  Payload ID: 12512
  Gene Symbol: PIGT
  Gene Name: phosphatidylinositol glycan anchor biosynthesis, class T
  Uniprot ID: Q969N2
  ENSP ID: ENSP00000279036
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 62658 - protein, 511 aa, Homo sapiens
  Payload ID: 12512
  Gene Symbol: PIGT
  Gene Name: phosphatidylinositol glycan anchor biosynthesis, class T
  Uniprot ID: Q969N2
  ENSP ID: ENSP00000361774
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENGYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 62659 - protein, 123 aa, Homo sapiens
  Payload ID: 12512
  Gene Symbol: PIGT
  Gene Name: phosphatidylinositol glycan anchor biosynthesis, class T
  ENSP ID: ENSP00000407574
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTEH

SEQ ID NO: 62660 - protein, 109 aa, Homo sapiens
  Payload ID: 12512
  Gene Symbol: PIGT
  Gene Name: phosphatidylinositol glycan anchor biosynthesis, class T
  ENSP ID: ENSP00000408354
  MOD_RES (1)..(1): Any amino acid
XLVLLLLGPGGWCLAEPPRDSLREELVITPLPSGDVAATFQFRTRWDSELQREGDWSLFRMFSRTLTEPCPLASESRVYVDITTYNQDNETLEVHPPPTTTYQDVILGT

SEQ ID NO: 62661 - protein, 522 aa, Homo sapiens
  Payload ID: 12512
  Gene Symbol: PIGT
  Gene Name: phosphatidylinositol glycan anchor biosynthesis, class T
  Uniprot ID: Q969N2
  ENSP ID: ENSP00000441577
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 62662 - protein, 172 aa, Homo sapiens
  Payload ID: 12512
  Gene Symbol: PIGT
  Gene Name: phosphatidylinositol glycan anchor biosynthesis, class T
  ENSP ID: ENSP00000443963
  MOD_RES (1)..(1): Any amino acid
XMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSL

SEQ ID NO: 62663 - protein, 435 aa, Homo sapiens
  Payload ID: 12513
  Gene Symbol: PIGU
  Gene Name: phosphatidylinositol glycan anchor biosynthesis, class U
  Uniprot ID: Q9H490
  ENSP ID: ENSP00000217446
MAAPLVLVLVVAVTVRAALFRSSLAEFISERVEVVSPLSSWKRVVEGLSLLDLGVSPYSGAVFHETPLIIYLFHFLIDYAELVFMITDALTAIALYFAIQDFNKVVFKKQKLLLELDQYAPDVAELIRTPMEMRYIPLKVALFYLLNPYTILSCVAKSTCAINNTLIAFFILTTIKGSAFLSAIFLALATYQSLYPLTLFVPGLLYLLQRQYIPVKMKSKAFWIFSWEYAMMYVGSLVVIICLSFFLLSSWDFIPAVYGFILSVPDLTPNIGLFWYFFAEMFEHFSLFFVCVFQINVFFYTIPLAIKLKEHPIFFMFIQIAVIAIFKSYPTVGDVALYMAFFPVWNHLYRFLRNIFVLTCIIIVCSLLFPVLWHLWIYAGSANSNFFYAITLTFNVGQILLISDYFYAFLRREYYLTHGLYLTAKDGTEAMLVLK

SEQ ID NO: 62664 - protein, 415 aa, Homo sapiens
  Payload ID: 12513
  Gene Symbol: PIGU
  Gene Name: phosphatidylinositol glycan anchor biosynthesis, class U
  Uniprot ID: Q9H490
  ENSP ID: ENSP00000363953
MAAPLVLVLVVAVTVRAALFRSSLAEFISERVEVVSPLSSWKRVVEGLSLLDLGVSPYSGAVFHEITDALTAIALYFAIQDFNKVVFKKQKLLLELDQYAPDVAELIRTPMEMRYIPLKVALFYLLNPYTILSCVAKSTCAINNTLIAFFILTTIKGSAFLSAIFLALATYQSLYPLTLFVPGLLYLLQRQYIPVKMKSKAFWIFSWEYAMMYVGSLVVIICLSFFLLSSWDFIPAVYGFILSVPDLTPNIGLFWYFFAEMFEHFSLFFVCVFQINVFFYTIPLAIKLKEHPIFFMFIQIAVIAIFKSYPTVGDVALYMAFFPVWNHLYRFLRNIFVLTCIIIVCSLLFPVLWHLWIYAGSANSNFFYAITLTFNVGQILLISDYFYAFLRREYYLTHGLYLTAKDGTEAMLVLK

SEQ ID NO: 62665 - protein, 169 aa, Homo sapiens
  Payload ID: 12513
  Gene Symbol: PIGU
  Gene Name: phosphatidylinositol glycan anchor biosynthesis, class U
  ENSP ID: ENSP00000395755
VSVPTHLVCPRTPLSPPAAVHTCENEEQSLLDLFLGVCHDINVFFYTIPLAIKLKEHPIFFMFIQIAVIAIFKSYPTVGDVALYMAFFPVWNHLYRFLRNIFVLTCIIIVCSLLFPVLWHLWIYAGSANSNFFYAITLTFNVGQILLISDYFYAFLRREYYLTHGLYLT

SEQ ID NO: 62666 - protein, 493 aa, Homo sapiens
  Payload ID: 12514
  Gene Symbol: PIGV
  Gene Name: phosphatidylinositol glycan anchor biosynthesis, class V
  Uniprot ID: Q9NUD9
  ENSP ID: ENSP00000078527
MWPQDPSRKEVLRFAVSCRILTLMLQALFNAIIPDHHAEAFSPPRLAPSGFVDQLVEGLLGGLSHWDAEHFLFIAEHGYLYEHNFAFFPGFPLALLVGTELLRPLRGLLSLRSCLLISVASLNFLFFMLAAVALHDLGCLVLHCPHQSFYAALLFCLSPANVFLAAGYSEALFALLTFSAMGQLERGRVWTSVLLFAFATGVRSNGLVSVGFLMHSQCQGFFSSLTMLNPLRQLFKLMASLFLSVFTLGLPFALFQYYAYTQFCLPGSARPIPEPLVQLAVDKGYRIAEGNEPPWCFWDVPLIYSYIQDVYWNVGFLKYYELKQVPNFLLAAPVAILVAWATWTYVTTHPWLCLTLGLQRSKNNKTLEKPDLGFLSPQVFVYVVHAAVLLLFGGLCMHVQVLTRFLGSSTPIMYWFPAHLLQDQEPLLRSLKTVPWKPLAEDSPPGQKVPRNPIMGLLYHWKTCSPVTRYILGYFLTYWLLGLLLHCNFLPWT

SEQ ID NO: 62667 - protein, 493 aa, Homo sapiens; identical to SEQ ID NO: 62666
  Payload ID: 12514
  Gene Symbol: PIGV
  Gene Name: phosphatidylinositol glycan anchor biosynthesis, class V
  Uniprot ID: Q9NUD9
  ENSP ID: ENSP00000363260

SEQ ID NO: 62668 - protein, 120 aa, Homo sapiens
  Payload ID: 12514
  Gene Symbol: PIGV
  Gene Name: phosphatidylinositol glycan anchor biosynthesis, class V
  ENSP ID: ENSP00000388425
MWPQDPSRKEVLRFAVSCRILTLMLQALFNAIIPDHHAEAFSPPRLAPSGFVDQLVEGLLGGLSHWDAEHFLFIAEHGYLYEHNFAFFPGFPLALLVGTELLRPLRGLLSLRSCLLISVA

SEQ ID NO: 62669 - protein, 72 aa, Homo sapiens
  Payload ID: 12514
  Gene Symbol: PIGV
  Gene Name: phosphatidylinositol glycan anchor biosynthesis, class V
  ENSP ID: ENSP00000399067
MWPQDPSRKEVLRFAVSCRILTLMLQALFNAIIPDHHAEAFSPPRLAPSGFVDQLVEGLLGGLSHWDAEHFL

SEQ ID NO: 62670 - protein, 182 aa, Homo sapiens
  Payload ID: 12514
  Gene Symbol: PIGV
  Gene Name: phosphatidylinositol glycan anchor biosynthesis, class V
  ENSP ID: ENSP00000406080
MWPQDPSRKEVLRFAVSCRILTLMLQALFNAIIPDHHAEAFSPPRLAPSGFVDQLVEGLLGGLSHWDAEHFLFIAEHGYLYEHNFAFFPGFPLALLVGTELLRPLRGLLSLRSCLLISVASLNFLFFMLAAVALHDLGCLVLHCPHQSFYAALLFCLSPANVFLAAGYSEALFALLTFSAMG

SEQ ID NO: 62671 - protein, 74 aa, Homo sapiens
  Payload ID: 12514
  Gene Symbol: PIGV
  Gene Name: phosphatidylinositol glycan anchor biosynthesis, class V
  ENSP ID: ENSP00000436884
MWPQDPSRKEVLRFAVSCRILTLMLQALFNAIIPDHHAEAFSPPRLAPSGFVDQLVEVLCLHPILSARLSPPHS

SEQ ID NO: 62672 - protein, 504 aa, Homo sapiens
  Payload ID: 12515
  Gene Symbol: PIGW
  Gene Name: phosphatidylinositol glycan anchor biosynthesis, class W
  Uniprot ID: Q7Z7B1
  ENSP ID: ENSP00000480021
MSEKQMKEAFVSNLNGTTVLEITQGLCFPAFCILCRGFLIIFSQYLCSFSPTWKTRFLTDFVVLIVPMVATLTIWASFILLELLGVIIFGAGLLYQIYRRRTCYARLPFLKILEKFLNISLESEYNPAISCFRVITSAFTAIAILAVDFPLFPRRFAKTELYGTGAMDFGVGGFVFGSAMVCLEVRRRKYMEGSKLHYFTNSLYSVWPLVFLGIGRLAIIKSIGYQEHLTEYGVHWNFFFTIIVVKLITPLLLIIFPLNKSWIIALGITVLYQLALDFTSLKRLILYGTDGSGTRVGLLNANREGIISTLGYVAIHMAGVQTGLYMHKNRSHIKDLIKVACFLLLAAISLFISLYVVQVNVEAVSRRMANLAFCIWIVASSLILLSSLLLGDIILSFAKFLIKGALVPCSWKLIQSPVTNKKHSESLVPEAERMEPSLCLITALNRKQLIFFLLSNITTGLINLMVDTLHSSTLWALFVVNLYMFSNCLIVYVLYLQDKTVQFW

SEQ ID NO: 62673 - protein, 277 aa, Homo sapiens
  Payload ID: 12515
  Gene Symbol: PIGW
  Gene Name: phosphatidylinositol glycan anchor biosynthesis, class W
  ENSP ID: ENSP00000480475
MSEKQMKEAFVSNLNGTTVLEITQGLCFPAFCILCRGFLIIFSQYLCSFSPTWKTRFLTDFVVLIVPMVATLTIWASFILLELLGVIIFGAGLLYQIYRRRTCYARLPFLKILEKFLNISLESEYNPAISCFRVITSAFTAIAILAVDFPLFPRRFAKTELYGTGAMDFGVGGFVFGSAMVCLEVRRRKYMEGSKLHYFTNSLYSVWPLVFLGIGRLAIIKSIGYQEHLTEYGVHWNFFFTIIVVKLITPLLLIIFPLNKSWIIALGITVLYQLALD

SEQ ID NO: 62674 - protein, 504 aa, Homo sapiens; identical to SEQ ID NO: 62672
  Payload ID: 12515
  Gene Symbol: PIGW
  Gene Name: phosphatidylinositol glycan anchor biosynthesis, class W
  Uniprot ID: Q7Z7B1
  ENSP ID: ENSP00000481144

SEQ ID NO: 62675 - protein, 504 aa, Homo sapiens; identical to SEQ ID NO: 62672
  Payload ID: 12515
  Gene Symbol: PIGW
  Gene Name: phosphatidylinositol glycan anchor biosynthesis, class W
  Uniprot ID: Q7Z7B1
  ENSP ID: ENSP00000482202

SEQ ID NO: 62676 - protein, 504 aa, Homo sapiens; identical to SEQ ID NO: 62672
  Payload ID: 12515
  Gene Symbol: PIGW
  Gene Name: phosphatidylinositol glycan anchor biosynthesis, class W
  Uniprot ID: Q7Z7B1
  ENSP ID: ENSP00000488033

SEQ ID NO: 62677 - protein, 277 aa, Homo sapiens; identical to SEQ ID NO: 62673
  Payload ID: 12515
  Gene Symbol: PIGW
  Gene Name: phosphatidylinositol glycan anchor biosynthesis, class W
  ENSP ID: ENSP00000488539

SEQ ID NO: 62678 - protein, 276 aa, Homo sapiens
  Payload ID: 12516
  Gene Symbol: PIGX
  Gene Name: phosphatidylinositol glycan anchor biosynthesis, class X
  ENSP ID: ENSP00000296333
LAARVAAVRAAAWLLLGAATGLTRGPAAAFTAARSDAGIRAMCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQAGSRRMIRFRFDSFDKTIEFPILKCWAHSEVAAPCALENEDICQWNKMKYKSVYKNVILQVPVGLTVHTSLVCSVTLLITILCSTLILVAVFKYGHFSL

SEQ ID NO: 62679 - protein, 258 aa, Homo sapiens
  Payload ID: 12516
  Gene Symbol: PIGX
  Gene Name: phosphatidylinositol glycan anchor biosynthesis, class X
  Uniprot ID: Q8TBF5
  ENSP ID: ENSP00000376192
LAARVAAVRAAAWLLLGAATGLTRGPAAAFTAARSDAGIRAMCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQEFPILKCWAHSEVAAPCALENEDICQWNKMKYKSVYKNVILQVPVGLTVHTSLVCSVTLLITILCSTLILVAVFKYGHFSL

SEQ ID NO: 62680 - protein, 127 aa, Homo sapiens
  Payload ID: 12516
  Gene Symbol: PIGX
  Gene Name: phosphatidylinositol glycan anchor biosynthesis, class X
  ENSP ID: ENSP00000390804
MCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNN

SEQ ID NO: 62681 - protein, 63 aa, Homo sapiens
  Payload ID: 12516
  Gene Symbol: PIGX
  Gene Name: phosphatidylinositol glycan anchor biosynthesis, class X
  ENSP ID: ENSP00000393424
AAAWLLLGAATGLTRGPAAAFTAARSDAGIRAMCSEIILRQEVLKDGFHRNSKYMYTRLLDIV

SEQ ID NO: 62682 - protein, 111 aa, Homo sapiens
  Payload ID: 12516
  Gene Symbol: PIGX
  Gene Name: phosphatidylinositol glycan anchor biosynthesis, class X
  ENSP ID: ENSP00000394722
AAAWLLLGAATGLTRGPAAAFTAARSDAGIRAMCSEIILRQEVLKDGFHRDLLIKVKFGESIEDLHTCRLLIKQDIPAGLYVDPYELASLRERNITEEKTSWRRLWLPSDN

SEQ ID NO: 62683 - protein, 170 aa, Homo sapiens
  Payload ID: 12516
  Gene Symbol: PIGX
  Gene Name: phosphatidylinositol glycan anchor biosynthesis, class X
  ENSP ID: ENSP00000409073
MCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQEFPILKCWAHSEVAAPCALENEDICQWNKMKYKS

SEQ ID NO: 62684 - protein, 79 aa, Homo sapiens
  Payload ID: 12516
  Gene Symbol: PIGX
  Gene Name: phosphatidylinositol glycan anchor biosynthesis, class X
  ENSP ID: ENSP00000413672
MCSEIILRQEVLKDGFHRDLLIKVKFGESIEDLHTCRLLIKQDIPAGLYVDPYELASLRERNITEEKTSWRRLWLPSDN

SEQ ID NO: 62685 - protein, 150 aa, Homo sapiens
  Payload ID: 12516
  Gene Symbol: PIGX
  Gene Name: phosphatidylinositol glycan anchor biosynthesis, class X
  ENSP ID: ENSP00000416446
MCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQGEGCKCFLRVETSE

SEQ ID NO: 62686 - protein, 71 aa, Homo sapiens
  Payload ID: 12517
  Gene Symbol: PIGY
  Gene Name: phosphatidylinositol glycan anchor biosynthesis, class Y
  Uniprot ID: Q3MUY2
  ENSP ID: ENSP00000432688
MFLSLPTLTVLIPLVSLAGLFYSASVEENFPQGCTSTASLCFYSLLLPITIPVYVFFHLWTWMGIKLFRHN

SEQ ID NO: 62687 - protein, 92 aa, Homo sapiens
  Payload ID: 12518
  Gene Symbol: PIGZ
  Gene Name: phosphatidylinositol glycan anchor biosynthesis, class Z
  ENSP ID: ENSP00000389327
MQICGSSVASVAAGTSFQVLGPVCWQQLDLKMAVRVLWGGLSLLRVLWCLLPQTGYVHPDEFFQSPEVMAGPSPTPLRDSSSRGCWCWYPPM

SEQ ID NO: 62688 - protein, 49 aa, Homo sapiens
  Payload ID: 12518
  Gene Symbol: PIGZ
  Gene Name: phosphatidylinositol glycan anchor biosynthesis, class Z
  ENSP ID: ENSP00000405341
  MOD_RES (1)..(1): Any amino acid
XRVLWGGLSLLRVLWCLLPQTGYVHPDEFFQSPEVMAGSGRSWGRGLAW

SEQ ID NO: 62689 - protein, 579 aa, Homo sapiens
  Payload ID: 12518
  Gene Symbol: PIGZ
  Gene Name: phosphatidylinositol glycan anchor biosynthesis, class Z
  Uniprot ID: Q86VD9
  ENSP ID: ENSP00000413405
MQICGSSVASVAAGTSFQVLGPVCWQQLDLKMAVRVLWGGLSLLRVLWCLLPQTGYVHPDEFFQSPEVMAEDILGVQAARPWEFYPSSSCRSVLFPLLISGSTFWLLRLWEELGPWPGLVSGYALLVGPRLLLTALSFALDGAVYHLAPPMGADRWNALALLSGSYVTLVFYTRTFSNTIEGLLFTWLLVLVSSHVTWGPTRKEPAPGPRWRSWLLGGIVAAGFFNRPTFLAFAVVPLYLWGTRGATNPGLKSLTREALVLLPGAALTAAVFVATDSWYFSSPATSRNLVLTPVNFLHYNLNPQNLARHGTHARLTHLAVNGFLLFGVLHAQALQAAWQRLQVGLQASAQMGLLRALGARSLLSSPRSYLLLLYFMPLALLSAFSHQEARFLIPLLVPLVLLCSPQTQPVPWKGTVVLFNALGALLFGCLHQGGLVPGLEYLEQVVHAPVLPSTPTHYTLLFTHTYMPPRHLLHLPGLGAPVEVVDMGGTEDWALCQTLKSFTRQPACQVAGGPWLCRLFVVTPGTTRRAVEKCSFPFKNETLLFPHLTLEDPPALSSLLSGAWRDHLSLHIVELGEET

SEQ ID NO: 62690 - protein, 270 aa, Homo sapiens
  Payload ID: 12519
  Gene Symbol: PITPNA
  Gene Name: phosphatidylinositol transfer protein, alpha
  Uniprot ID: Q00169
  ENSP ID: ENSP00000316809
MVLLKEYRVILPVSVDEYQVGQLYSVAEASKNETGGGEGVEVLVNEPYEKDGEKGQYTHKIYHLQSKVPTFVRMLAPEGALNIHEKAWNAYPYCRTVITNEYMKEDFLIKIETWHKPDLGTQENVHKLEPEAWKHVEAVYIDIADRSQVLSKDYKAEEDPAKFKSIKTGRGPLGPNWKQELVNQKDCPYMCAYKLVTVKFKWWGLQNKVENFIHKQERRLFTNFHRQLFCWLDKWVDLTMDDIRRMEEETKRQLDEMRQKDPVKGMTADD

SEQ ID NO: 62691 - protein, 270 aa, Homo sapiens [sequence omitted]

SEQ ID NO: 62692 - protein, 83 aa, Homo sapiens
  Payload ID: 12519
  Gene Symbol: PITPNA
  Gene Name: phosphatidylinositol transfer protein, alpha
  ENSP ID: ENSP00000460008
MLAPEGALNIHEKAWNAYPYCRTVITNEYMKEDFLIKIETWHKPDLGTQENVHKLEPEAWKHVEAVYIDIADRSQVLSKDYKA

SEQ ID NO: 62693 - protein, 44 aa, Homo sapiens
  Payload ID: 12519
  Gene Symbol: PITPNA
  Gene Name: phosphatidylinositol transfer protein, alpha
  ENSP ID: ENSP00000460771
MLAPEGALNIHEKAWNAYPYCRTVITNEYMKEDFLIKIETWHKP

SEQ ID NO: 62694 - protein, 142 aa, Homo sapiens
  Payload ID: 12519
  Gene Symbol: PITPNA
  Gene Name: phosphatidylinositol transfer protein, alpha
  ENSP ID: ENSP00000460983
MLAPEGALNIHEKAWNAYPYCRTVITNEYMKEDFLIKIETWHKPDLGTQENVHKLEPEAWKHVEAVYIDIADRSQVLSKDYKAEEDPAKFKSIKTGRGPLGPNWKQELVNQKDCPYMCAYKLVTVKFKWWGLQNKVENFIHK

SEQ ID NO: 62695 - protein, 98 aa, Homo sapiens
  Payload ID: 12519
  Gene Symbol: PITPNA
  Gene Name: phosphatidylinositol transfer protein, alpha
  ENSP ID: ENSP00000461011
MVLLKEYRVILPVSVDEYQVGQLYSVAEASKNETGGGEGVEVLVNEPYEKDGEKGQYTHKIYHLQSKVPTFVRMLAPEGALNIHEKAWNAYPYCRTGA

SEQ ID NO: 62696 - protein, 115 aa, Homo sapiens
  Payload ID: 12519
  Gene Symbol: PITPNA
  Gene Name: phosphatidylinositol transfer protein, alpha
  ENSP ID: ENSP00000461140
MLAPEGALNIHEKAWNAYPYCRTVITNEYMKEDFLIKIETWHKPDLGTQENVHKLEPEAWKHVEAVYIDIADRSQVLSKDYKAEEDPAKFKSIKTGRGPLGPNWKQELVNQKDCP

SEQ ID NO: 62697 - protein, 209 aa, Homo sapiens
  Payload ID: 12519
  Gene Symbol: PITPNA
  Gene Name: phosphatidylinositol transfer protein, alpha
  ENSP ID: ENSP00000461245
  MOD_RES (1)..(1): Any amino acid
XVNEPYEKDGEKGQYTHKIYHLQSKVPTFVRMLAPEGALNIHEKAWNAYPYCRTVITNEYMKEDFLIKIETWHKPDLGTQENVHKLEPEAWKHVEAVYIDIADRSQVLSKVFPGDLDAHPRLKVSVFNTDYKAEEDPAKFKSIKTGRGPLGPNWKQELVNQKDCPYMCAYKLVTVKFKWWGLQNKVENFIHKQERRLFTNFHRQLFCWL

SEQ ID NO: 62698 - protein, 121 aa, Homo sapiens
  Payload ID: 12519
  Gene Symbol: PITPNA
  Gene Name: phosphatidylinositol transfer protein, alpha
  ENSP ID: ENSP00000461539
MQDTKGPRGLQQGSGDRTSKLGNWLDLYGRVILPVSVDEYQVGQLYSVAEASKNETGGGEGVEVLVNEPYEKDGEKGQYTHKIYHLQSKVPTFVRMLAPEGALNIHEKAWNAYPYCRTVIT

SEQ ID NO: 62699 - protein, 66 aa, Homo sapiens
  Payload ID: 12519
  Gene Symbol: PITPNA
  Gene Name: phosphatidylinositol transfer protein, alpha
  ENSP ID: ENSP00000461801
MKEDFLIKIETWHKPDLGTQENVHKLEPEAWKHVEAVYIDIADRSQVLSKDYKAEEDPAKFKSIKT

SEQ ID NO: 62700 - protein, 272 aa, Homo sapiens
  Payload ID: 12520
  Gene Symbol: PITPNB
  Gene Name: phosphatidylinositol transfer protein, beta
  Uniprot ID: P48739
  ENSP ID: ENSP00000321266
MVLIKEFRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETLRNQGQVRGTSAASDE

SEQ ID NO: 62701 - protein, 271 aa, Homo sapiens
  Payload ID: 12520
  Gene Symbol: PITPNB
  Gene Name: phosphatidylinositol transfer protein, beta
  Uniprot ID: P48739
  ENSP ID: ENSP00000334738
MVLIKEFRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETMRKRGSVRGTSAADV

SEQ ID NO: 62702 - protein, 167 aa, Homo sapiens
  Payload ID: 12520
  Gene Symbol: PITPNB
  Gene Name: phosphatidylinositol transfer protein, beta
  ENSP ID: ENSP00000403675
MGDLLMEKCRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQS

SEQ ID NO: 62703 - protein, 271 aa, Homo sapiens [sequence omitted]

SEQ ID NO: 62704 - protein, 120 aa, Homo sapiens
  Payload ID: 12520
  Gene Symbol: PITPNB
  Gene Name: phosphatidylinositol transfer protein, beta
  ENSP ID: ENSP00000406542
MIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAY

SEQ ID NO: 62705 - protein, 273 aa, Homo sapiens
  Payload ID: 12520
  Gene Symbol: PITPNB
  Gene Name: phosphatidylinositol transfer protein, beta
  Uniprot ID: P48739
  ENSP ID: ENSP00000487693
MGDLLMEKCRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETMRKRGSVRGTSAADV

SEQ ID NO: 62706 - protein, 266 aa, Homo sapiens
  Payload ID: 12521
  Gene Symbol: PITPNC1
  Gene Name: phosphatidylinositol transfer protein, cytoplasmic 1
  ENSP ID: ENSP00000299954
MLLKEYRICMPLTVDEYKIGQLYMISKHSHEQSDRGEGVEVVQNEPFEDPHHGNGQFTEKRVYLNSKLPSWARAVVPKIFYVTEKAWNYYPYTITECSFLPKFSIHIETKYEDNKGSNDTIFDNEAKDVEREVCFIDIACDEIPERYYKESEDPKHFKSEKTGRGQLREGWRDSHQPIMCSYKLVTVKFEVWGLQTRVEQFVHKVVRDILLIGHRQAFAWVDEWYDMTMDDVREYEKNMHEQTNIKVCNQHSSPVDDIESHAQTST

SEQ ID NO: 62707 - protein, 268 aa, Homo sapiens
  Payload ID: 12521
  Gene Symbol: PITPNC1
  Gene Name: phosphatidylinositol transfer protein, cytoplasmic 1
  ENSP ID: ENSP00000463626
MLLKEYRICMPLTVDEYKIGQLYMISKHSHEQSDRGEGVEVVQNEPFEDPHHGNGQFTEKRVYLNSKLPSWARAVVPKIFYVTEKAWNYYPYTITEYTCSFLPKFSIHIETKYEDNKGSNDTIFDNEAKDVEREVCFIDIACDEIPERYYKESEDPKHFKSEKTGRGQLREGWRDSHQPIMCSYKLVTVKFEVWGLQTRVEQFVHKVVRDILLIGHRQAFAWVDEWYDMTMDDVREYEKNMHEQTNIKVCNQHSSPVDDIESHAQTST

SEQ ID NO: 62708 - protein, 332 aa, Homo sapiens
  Payload ID: 12521
  Gene Symbol: PITPNC1
  Gene Name: phosphatidylinositol transfer protein, cytoplasmic 1
  Uniprot ID: Q9UKF7
  ENSP ID: ENSP00000464006
MLLKEYRICMPLTVDEYKIGQLYMISKHSHEQSDRGEGVEVVQNEPFEDPHHGNGQFTEKRVYLNSKLPSWARAVVPKIFYVTEKAWNYYPYTITEYTCSFLPKFSIHIETKYEDNKGSNDTIFDNEAKDVEREVCFIDIACDEIPERYYKESEDPKHFKSEKTGRGQLREGWRDSHQPIMCSYKLVTVKFEVWGLQTRVEQFVHKVVRDILLIGHRQAFAWVDEWYDMTMDEVREFERATQEATNKKIGIFPPAISISSIPLLPSSVRSAPSSAPSTPLSTDAPEFLSVPKDRPRKKSAPETLTLPDPEKKATLNLPGMHSSDKPCRPKSE

SEQ ID NO: 62709 - protein, 98 aa, Homo sapiens
  Payload ID: 12521
  Gene Symbol: PITPNC1
  Gene Name: phosphatidylinositol transfer protein, cytoplasmic 1
  ENSP ID: ENSP00000464364
MISKHSHEQSDRGEGVEVVQNEPFEDPHHGNGQFTEKRVYLNSKLPSWARAVVPKIFYVTEKAWNYYPYTITEYTCSFLPKFSIHIETKYEDNKGSND

SEQ ID NO: 62710 - protein, 88 aa, Homo sapiens
  Payload ID: 12521
  Gene Symbol: PITPNC1
  Gene Name: phosphatidylinositol transfer protein, cytoplasmic 1
  ENSP ID: ENSP00000464584
MISKHSHEQSDRGEGVEVVQNEPFEDPHHGNGQFTEKRVYLNSKLPSWARAVVPKIFYVTEKAWNYYPYTITEYTCSFLPKFSIHIET

SEQ ID NO: 62711 - protein, 1244 aa, Homo sapiens
  Payload ID: 12522
  Gene Symbol: PITPNM1
  Gene Name: phosphatidylinositol transfer protein, membrane-associated 1
  Uniprot ID: O00562
  ENSP ID: ENSP00000348772
MLIKEYHILLPMSLDEYQVAQLYMIQKKSREESSGEGSGVEILANRPYTDGPGGSGQYTHKVYHVGSHIPGWFRALLPKAALQVEEESWNAYPYTRTRYTCPFVEKFSIEIETYYLPDGGQQPNVFNLSGAERRQRILDTIDIVRDAVAPGEYKAEEDPRLYHSVKTGRGPLSDDWARTAAQTGPLMCAYKLCKVEFRYWGMQAKIEQFIHDVGLRRVMLRAHRQAWCWQDEWTELSMADIRALEEETARMLAQRMAKCNTGSEGSEAQPPGKPSTEARSAASNTGTPDGPEAPPGPDASPDASFGKQWSSSSRSSYSSQHGGAVSPQSLSEWRMQNIARDSENSSEEEFFDAHEGFSDSEEVFPKEMTKWNSNDFIDAFASPVEAEGTPEPGAEAAKGIEDGAQAPRDSEGLDGAGELGAEACAVHALFLILHSGNILDSGPGDANSKQADVQTLSSAFEAVTRIHFPEALGHVALRLVPCPPICAAAYALVSNLSPYSHDGDSLSRSQDHIPLAALPLLATSSSRYQGAVATVIARTNQAYSAFLRSPEGAGFCGQVALIGDGVGGILGFDALCHSANAGTGSRGSSRRGSMNNELLSPEFGPVRDPLADGVEGLGRGSPEPSALPPQRIPSDMASPEPEGSQNSLQAAPATTSSWEPRRASTAFCPPAASSEAPDGPSSTARLDFKVSGFFLFGSPLGLVLALRKTVMPALEAAQMRPACEQIYNLFHAADPCASRLEPLLAPKFQAIAPLTVPRYQKFPLGDGSSLLLADTLQTHSSLFLEELEMLVPSTPTSTSGAFWKGSELATDPPAQPAAPSTTSEVVKILERWWGTKRIDYSLYCPEALTAFPTVTLPHLFHASYWESADVVAFILRQVIEKERPQLAECEEPSIYSPAFPREKWQRKRTQVKIRNVTSNHRASDTVVCEGRPQVLSGRFMYGPLDVVTLTGEKVDVYIMTQPLSGKWIHFGTEVTNSSGRLTFPVPPERALGIGVYPVRMVVRGDHTYAECCLTVVARGTEAVVFSIDGSFTASVSIMGSDPKVRAGAVDVVRHWQDSGYLIVYVTGRPDMQKHRVVAWLSQHNFPHGVVSFCDGLTHDPLRQKAMFLQSLVQEVELNIVAGYGSPKDVAVYAALGLSPSQTYIVGRAVRKLQAQCQFLSDGYVAHLGQLEAGSHSHASSGPPRAALGKSSYGVAAPVDFLRKQSQLLRSRGPSQAEREGPGTPPTTLARGKARSISLKLDSEE

SEQ ID NO: 62712 - protein, 1243 aa, Homo sapiens
  Payload ID: 12522
  Gene Symbol: PITPNM1
  Gene Name: phosphatidylinositol transfer protein, membrane-associated 1
  Uniprot ID: O00562
  ENSP ID: ENSP00000398787
MLIKEYHILLPMSLDEYQVAQLYMIQKKSREESSGEGSGVEILANRPYTDGPGGSGQYTHKVYHVGSHIPGWFRALLPKAALQVEEESWNAYPYTRTRYTCPFVEKFSIEIETYYLPDGGQQPNVFNLSGAERRQRILDTIDIVRDAVAPGEYKAEEDPRLYHSVKTGRGPLSDDWARTAAQTGPLMCAYKLCKVEFRYWGMQAKIEQFIHDVGLRRVMLRAHRQAWCWQDEWTELSMADIRALEEETARMLAQRMAKCNTGSEGSEAQPPGKPSTEARSAASNTGTPDGPEAPPGPDASPDASFGKQWSSSSRSSYSSQHGGAVSPQSLSEWRMQNIARDSENSSEEEFFDAHEGFSDSEEVFPKEMTKWNSNDFIDAFASPVEAEGTPEPGAEAAKGIEDGAQAPRDSEGLDGAGELGAEACAVHALFLILHSGNILDSGPGDANSKQADVQTLSSAFEAVTRIHFPEALGHVALRLVPCPPICAAAYALVSNLSPYSHDGDSLSRSQDHIPLAALPLLATSSSRYQGAVATVIARTNQAYSAFLRSPEGAGFCGQVALIGDGVGGILGFDALCHSANAGTGSRGSSRRGSMNNELLSPEFGPVRDPLADGVEGLGRGSPEPSALPPQRIPSDMASPEPEGSQNSLQAAPATTSSWEPRRASTAFCPPAASSEAPDGPSSTARLDFKVSGFFLFGSPLGLVLALRKTVMPALEAQMRPACEQIYNLFHAADPCASRLEPLLAPKFQAIAPLTVPRYQKFPLGDGSSLLLADTLQTHSSLFLEELEMLVPSTPTSTSGAFWKGSELATDPPAQPAAPSTTSEVVKILERWWGTKRIDYSLYCPEALTAFPTVTLPHLFHASYWESADVVAFILRQVIEKERPQLAECEEPSIYSPAFPREKWQRKRTQVKIRNVTSNHRASDTVVCEGRPQVLSGRFMYGPLDVVTLTGEKVDVYIMTQPLSGKWIHFGTEVTNSSGRLTFPVPPERALGIGVYPVRMVVRGDHTYAECCLTVVARGTEAVVFSIDGSFTASVSIMGSDPKVRAGAVDVVRHWQDSGYLIVYVTGRPDMQKHRVVAWLSQHNFPHGVVSFCDGLTHDPLRQKAMFLQSLVQEVELNIVAGYGSPKDVAVYAALGLSPSQTYIVGRAVRKLQAQCQFLSDGYVAHLGQLEAGSHSHASSGPPRAALGKSSYGVAAPVDFLRKQSQLLRSRGPSQAEREGPGTPPTTLARGKARSISLKLDSEE

SEQ ID NO: 62713 - protein, 88 aa, Homo sapiens
  Payload ID: 12522
  Gene Symbol: PITPNM1
  Gene Name: phosphatidylinositol transfer protein, membrane-associated 1
  ENSP ID: ENSP00000432746
MLIKEYHILLPMSLDEYQVAQLYMIQKKSREESSGEGSGVEILANRPYTDGPGGSGQYTHKVYHVGSHIPGWFRALLPKAALQVEEES

SEQ ID NO: 62714 - protein, 154 aa, Homo sapiens
  Payload ID: 12522
  Gene Symbol: PITPNM1
  Gene Name: phosphatidylinositol transfer protein, membrane-associated 1
  ENSP ID: ENSP00000432977
MLIKEYHILLPMSLDEYQVAQLYMIQKKSREESSGEGSGVEILANRPYTDGPGGSGQYTHKVYHVGSHIPGWFRALLPKAALQVEEESWNAYPYTRTRYTCPFVEKFSIEIETYYLPDGGQQPNVFNLSGAERRQRILDTIDIVRDAVAPGEYK

SEQ ID NO: 62715 - protein, 163 aa, Homo sapiens
  Payload ID: 12522
  Gene Symbol: PITPNM1
  Gene Name: phosphatidylinositol transfer protein, membrane-associated 1
  ENSP ID: ENSP00000434046
MLIKEYHILLPMSLDEYQVAQLYMIQKKSREESSGEGSGVEILANRPYTDGPGGSGQYTHKVYHVGSHIPGWFRALLPKAALQVEEESWNAYPYTRTRYTCPFVEKFSIEIETYYLPDGGQQPNVFNLSGAERRQRILDTIDIVRDAVAPGEYKAEEDPRLYH

SEQ ID NO: 62716 - protein, 151 aa, Homo sapiens
  Payload ID: 12522
  Gene Symbol: PITPNM1
  Gene Name: phosphatidylinositol transfer protein, membrane-associated 1
  ENSP ID: ENSP00000434904
MLIKEYHILLPMSLDEYQVAQLYMIQKKSREESSGEGSGVEILANRPYTDGPGGSGQYTHKVYHVGSHIPGWFRALLPKAALQVEEESWNAYPYTRTRYTCPFVEKFSIEIETYYLPDGGQQPNVFNLSGAERRQRILDTIDIVRDAVAPG

SEQ ID NO: 62717 - protein, 1244 aa, Homo sapiens; identical to SEQ ID NO: 62711
  Payload ID: 12522
  Gene Symbol: PITPNM1
  Gene Name: phosphatidylinositol transfer protein, membrane-associated 1
  Uniprot ID: O00562
  ENSP ID: ENSP00000437286

SEQ ID NO: 62718 - protein, 1343 aa, Homo sapiens
  Payload ID: 12523
  Gene Symbol: PITPNM2
  Gene Name: phosphatidylinositol transfer protein, membrane-associated 2
  Uniprot ID: Q9BZ72
  ENSP ID: ENSP00000280562
MIIKEYRIPLPMTVEEYRIAQLYMIQKKSRNETYGEGSGVEILENRPYTDGPGGSGQYTHKVYHVGMHIPSWFRSILPKAALRVVEESWNAYPYTRTRFTCPFVEKFSIDIETFYKTDAGENPDVFNLSPVEKNQLTIDFIDIVKDPVPHNEYKTEEDPKLFQSTKTQRGPLSENWIEEYKKQVFPIMCAYKLCKVEFRYWGMQSKIERFIHDTGLRRVMVRAHRQAWCWQDEWYGLSMENIRELEKEAQLMLSRKMAQFNEDGEEATELVKHEAVSDQTSGEPPEPSSSNGEPLVGRGLKKQWSTSSKSSRSSKRGASPSRHSISEWRMQSIARDSDESSDDEFFDAHEDLSDTEEMFPKDITKWSSNDLMDKIESPEPEDTQDGLYRQGAPEFRVASSVEQLNIIEDEVSQPLAAPPSKIHVLLLVLHGGTILDTGAGDPSSKKGDANTIANVFDTVMRVHYPSALGRLAIRLVPCPPVCSDAFALVSNLSPYSHDEGCLSSSQDHIPLAALPLLATSSPQYQEAVATVIQRANLAYGDFIKSQEGMTFNGQVCLIGDCVGGILAFDALCYSNQPVSESQSSSRRGSVVSMQDNDLLSPGILMNAAHCCGGGGGGGGGGGSSGGGGSSGGSSLESSRHLSRSNVDIPRSNGTEDPKRQLPRKRSDSSTYELDTIQQHQAFLSSLHASVLRTEPCSRHSSSSTMLDGTGALGRFDFEITDLFLFGCPLGLVLALRKTVIPALDVFQLRPACQQVYNLFHPADPSASRLEPLLERRFHALPPFSVPRYQRYPLGDGCSTLLVETVQRNPELVLEGGPLAPLPHGDGFLETSMPVPAPTWQDGPRPGCAESDVLQTHNAAFQEHGAPSSPGTAPASRGFRRASEISIASQVSGMAESYTASSIAQIAAKWWGQKRIDYALYCPDALTAFPTVALPHLFHASYWESTDVVSFLLRQVMRHDNSSILELDGKEVSVFTPSKPREKWQRKRTHVKLRNVTANHRINDALANEDGPQVLTGRFMYGPLDMVTLTGEKVDVHIMTQPPSGEWLYLDTLVTNNSGRVSYTIPESHRLGVGVYPIKMVVRGDHTFADSYITVLPKGTEFVVFSIDGSFAASVSIMGSDPKVRAGAVDVVRHWQDLGYLIIYVTGRPDMQKQRVVAWLAQHNFPHGVVSFCDGLVHDPLRHKANFLKLLISELHLRVHAAYGSTKDVAVYSAISLSPMQIYIVGRPTKKLQQQCQFITDGYAAHLAQLKYSHRARPARNTATRMALRKGSFGLPGQGDFLRSRNHLLRTISAQPSGPSHRHERTQSQADGEQRGQRSMSVAAGCWGRAMTGRLEPGAAAGPK

SEQ ID NO: 62719 - protein, 1349 aa, Homo sapiens
  Payload ID: 12523
  Gene Symbol: PITPNM2
  Gene Name: phosphatidylinositol transfer protein, membrane-associated 2
  Uniprot ID: Q9BZ72
  ENSP ID: ENSP00000322218
MIIKEYRIPLPMTVEEYRIAQLYMIQKKSRNETYGEGSGVEILENRPYTDGPGGSGQYTHKVYHVGMHIPSWFRSILPKAALRVVEESWNAYPYTRTRFTCPFVEKFSIDIETFYKTDAGENPDVFNLSPVEKNQLTIDFIDIVKDPVPHNEYKTEEDPKLFQSTKTQRGPLSENWIEEYKKQVFPIMCAYKLCKVEFRYWGMQSKIERFIHDTGLRRVMVRAHRQAWCWQDEWYGLSMENIRELEKEAQLMLSRKMAQFNEDGEEATELVKHEAVSDQTSGEPPEPSSSNGEPLVGRGLKKQWSTSSKSSRSSKRGASPSRHSISEWRMQSIARDSDESSDDEFFDAHEDLSDTEEMFPKDITKWSSNDLMDKIESPEPEDTQDGLYRQGAPEFRVASSVEQLNIIEDEVSQPLAAPPSKIHVLLLVLHGGTILDTGAGDPSSKKGDANTIANVFDTVMRVHYPSALGRLAIRLVPCPPVCSDAFALVSNLSPYSHDEGCLSSSQDHIPLAALPLLATSSPQYQEAVATVIQRANLAYGDFIKSQEGMTFNGQVCLIGDCVGGILAFDALCYSNQPVSESQSSSRRGSVVSMQDNDLLSPGILMNAAHCCGGGGGGGGGGGSSGGGGSSGGSSLESSRHLSRSNVDIPRSNGTEDPKRQLPRKRSDSSTYELDTIQQHQAFLSSLHASVLRTEPCSRHSSSSTMLDGTGALGRFDFEITDLFLFGCPLGLVLALRKTVIPALDVFQLRPACQQVYNLFHPADPSASRLEPLLERRFHALPPFSVPRYQRYPLGDGCSTLLADVLQTHNAAFQEHGAPSSPGTAPASRGFRRASEISIASQVSGMAESYTASSIAQKAPDALSHTPSVRRLSLLALPAPSPTTPGPHPPARKASPGLERAPGLPELDIGEVAAKWWGQKRIDYALYCPDALTAFPTVALPHLFHASYWESTDVVSFLLRQVMRHDNSSILELDGKEVSVFTPSKPREKWQRKRTHVKLRNVTANHRINDALANEDGPQVLTGRFMYGPLDMVTLTGEKVDVHIMTQPPSGEWLYLDTLVTNNSGRVSYTIPESHRLGVGVYPIKMVVRGDHTFADSYITVLPKGTEFVVFSIDGSFAASVSIMGSDPKVRAGAVDVVRHWQDLGYLIIYVTGRPDMQKQRVVAWLAQHNFPHGVVSFCDGLVHDPLRHKANFLKLLISELHLRVHAAYGSTKDVAVYSAISLSPMQIYIVGRPTKKLQQQCQFITDGYAAHLAQLKYSHRARPARNTATRMALRKGSFGLPGQGDFLRSRNHLLRTISAQPSGPSHRHERTQSQADGEQRGQRSMSVAAGCWGRAMTGRLEPGAAAGPK

SEQ ID NO: 62720 - protein, 1349 aa, Homo sapiens; identical to SEQ ID NO: 62719
  Payload ID: 12523
  Gene Symbol: PITPNM2
  Gene Name: phosphatidylinositol transfer protein, membrane-associated 2
  Uniprot ID: Q9BZ72
  ENSP ID: ENSP00000437611

SEQ ID NO: 62721 - protein, 41 aa, Homo sapiens
  Payload ID: 12523
  Gene Symbol: PITPNM2
  Gene Name: phosphatidylinositol transfer protein, membrane-associated 2
  ENSP ID: ENSP00000437869
MIIKEYRIPLPMTVEEYRIAQLYMIQKKSRNETYGEGSGVE

SEQ ID NO: 62722 - protein, 15 aa, Homo sapiens
  Payload ID: 12523
  Gene Symbol: PITPNM2
  Gene Name: phosphatidylinositol transfer protein, membrane-associated 2
  ENSP ID: ENSP00000445399
MIIKEYRIPLPMTVE

SEQ ID NO: 62723 - protein, 478 aa, Homo sapiens
  Payload ID: 12523
  Gene Symbol: PITPNM2
  Gene Name: phosphatidylinositol transfer protein, membrane-associated 2
  ENSP ID: ENSP00000474962
MIIKEYRIPLPMTVEEYRIAQLYMIQKKSRNETYGEGSGVEILENRPYTDGPGGSGQYTHKVYHVGMHIPSWFRSILPKAALRVVEESWNAYPYTRTRFTCPFVEKFSIDIETFYKTDAGENPDVFNLSPVEKNQLTIDFIDIVKDPVPHNEYKTEEDPKLFQSTKTQRGPLSENWIEEYKKQVFPIMCAYKLCKVEFRYWGMQSKIERFIHDTGLRRVMVRAHRQAWCWQDEWYGLSMENIRELEKEAQLMLSRKMAQFNEDGEEATELVKHEAVSDQTSGEPPEPSSSNGEPLVGRGLKKQWSTSSKSSRSSKRGASVMPVRPVGGPPCLLPAQGSLWALPLQLAVNLGFCLPASPSRHSISEWRMQSIARDSDESSDDEFFDAHEDLSDTEEMFPKDITKWSSNDLMDKIESPEPEDTQDGLYRQGAPEFRVASSVEQLNIIEIKNKIFTLCPACLLSLKIKRRKGRKRQSSRQK

SEQ ID NO: 62724 - protein, 1659 aa, Homo sapiens
  Payload ID: 12524
  Gene Symbol: PREX1
  Gene Name: phosphatidylinositol-3,4,5-trisphosphate-dependent Rac exchange factor 1
  Uniprot ID: Q8TCU6
  ENSP ID: ENSP00000361009
MEAPSGSEPGGDGAGDCAHPDPRAPGAAAPSSGPGPCAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSKQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 62725 - protein, 883 aa, Homo sapiens
  Payload ID: 12524
  Gene Symbol: PREX1
  Gene Name: phosphatidylinositol-3,4,5-trisphosphate-dependent Rac exchange factor 1
  ENSP ID: ENSP00000434632
  MOD_RES (1)..(1): Any amino acid
XPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSKQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKGELQAWGREDHGGRAKATKHTGSQPPARPRHLPSQCWRTWRGCLLQAARPRRICSRTSTRSPWRKFSSITANSGHFTWSGLTCPRMPAPRR

SEQ ID NO: 62726 - protein, 12 aa, Homo sapiens
  Payload ID: 12524
  Gene Symbol: PREX1
  Gene Name: phosphatidylinositol-3,4,5-trisphosphate-dependent Rac exchange factor 1
  ENSP ID: ENSP00000481444
EDGTGSPSPSLA

SEQ ID NO: 62727 - protein, 1606 aa, Homo sapiens
  Payload ID: 12525
  Gene Symbol: PREX2
  Gene Name: phosphatidylinositol-3,4,5-trisphosphate-dependent Rac exchange factor 2
  Uniprot ID: Q70Z35
  ENSP ID: ENSP00000288368
MSEDSRGDSRAESAKDLEKQLRLRVCVLSELQKTERDYVGTLEFLVSAFLHRMNQCAASKVDKNVTEETVKMLFSNIEDILAVHKEFLKVVEECLHPEPNAQQEVGTCFLHFKDKFRIYDEYCSNHEKAQKLLLELNKIRTIRTFLLNCMLLGGRKNTDVPLEGYLVTPIQRICKYPLILKELLKRTPRKHSDYAAVMEALQAMKAVCSNINEAKRQMEKLEVLEEWQSHIEGWEGSNITDTCTEMLMCGVLLKISSGNIQERVFFLFDNLLVYCKRKHRRLKNSKASTDGHRYLFRGRINTEVMEVENVDDGTADFHSSGHIVVNGWKIHNTAKNKWFVCMAKTPEEKHEWFEAILKERERRKGLKLGMEQDTWVMISEQGEKLYKMMCRQGNLIKDRKRKLTTFPKCFLGSEFVSWLLEIGEIHRPEEGVHLGQALLENGIIHHVTDKHQFKPEQMLYRFRYDDGTFYPRNEMQDVISKGVRLYCRLHSLFTPVIRDKDYHLRTYKSVVMANKLIDWLIAQGDCRTREEAMIFGVGLCDNGFMHHVLEKSEFKDEPLLFRFFSDEEMEGSNMKHRLMKHDLKVVENVIAKSLLIKSNEGSYGFGLEDKNKVPIIKLVEKGSNAEMAGMEVGKKIFAINGDLVFMRPFNEVDCFLKSCLNSRKPLRVLVSTKPRETVKIPDSADGLGFQIRGFGPSVVHAVGRGTVAAAAGLHPGQCIIKVNGINVSKETHASVIAHVTACRKYRRPTKQDSIQWVYNSIESAQEDLQKSHSKPPGDEAGDAFDCKVEEVIDKFNTMAIIDGKKEHVSLTVDNVHLEYGVVYEYDSTAGIKCNVVEKMIEPKGFFSLTAKILEALAKSDEHFVQNCTSLNSLNEVIPTDLQSKFSALCSERIEHLCQRISSYKKFSRVLKNRAWPTFKQAKSKISPLHSSDFCPTNCHVNVMEVSYPKTSTSLGSAFGVQLDSRKHNSHDKENKSSEQGKLSPMVYIQHTITTMAAPSGLSLGQQDGHGLRYLLKEEDLETQDIYQKLLGKLQTALKEVEMCVCQIDDLLSSITYSPKLERKTSEGIIPTDSDNEKGERNSKRVCFNVAGDEQEDSGHDTISNRDSYSDCNSNRNSIASFTSICSSQCSSYFHSDEMDSGDELPLSVRISHDKQDKIHSCLEHLFSQVDSITNLLKGQAVVRAFDQTKYLTPGRGLQEFQQEMEPKLSCPKRLRLHIKQDPWNLPSSVRTLAQNIRKFVEEVKCRLLLALLEYSDSETQLRRDMVFCQTLVATVCAFSEQLMAALNQMFDNSKENEMETWEASRRWLDQIANAGVLFHFQSLLSPNLTDEQAMLEDTLVALFDLEKVSFYFKPSEEEPLVANVPLTYQAEGSRQALKVYFYIDSYHFEQLPQRLKNGGGFKIHPVLFAQALESMEGYYYRDNVSVEEFQAQINAASLEKVKQYNQKLRAFYLDKSNSPPNSTSKAAYVDKLMRPLNALDELYRLVASFIRSKRTAACANTACSASGVGLLSVSSELCNRLGACHIIMCSSGVHRCTLSVTLEQAIILARSHGLPPRYIMQATDVMRKQGARVQNTAKNLGVRDRTPQSAPRLYKLCEPPPPAGEE

SEQ ID NO: 62728 - protein, 1068 aa, Homo sapiens
  Payload ID: 12526
  Gene Symbol: PIK3CA
  Gene Name: phosphatidylinositol-4,5-bisphosphate 3-kinase, catalytic subunit alpha
  Uniprot ID: P42336
  ENSP ID: ENSP00000263967
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 62729 - protein, 118 aa, Homo sapiens
  Payload ID: 12526
  Gene Symbol: PIK3CA
  Gene Name: phosphatidylinositol-4,5-bisphosphate 3-kinase, catalytic subunit alpha
  ENSP ID: ENSP00000417479
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIG

SEQ ID NO: 62730 - protein, 21 aa, Homo sapiens
  Payload ID: 12526
  Gene Symbol: PIK3CA
  Gene Name: phosphatidylinositol-4,5-bisphosphate 3-kinase, catalytic subunit alpha
  ENSP ID: ENSP00000418145
MPPRPSSGELWGIHLMPPRIL

SEQ ID NO: 62731 - protein, 1070 aa, Homo sapiens
  Payload ID: 12527
  Gene Symbol: PIK3CB
  Gene Name: phosphatidylinositol-4,5-bisphosphate 3-kinase, catalytic subunit beta
  Uniprot ID: P42338
  ENSP ID: ENSP00000289153
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKIIEKAAEIASSDSANVSSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 62732 - protein, 56 aa, Homo sapiens
  Payload ID: 12527
  Gene Symbol: PIK3CB
  Gene Name: phosphatidylinositol-4,5-bisphosphate 3-kinase, catalytic subunit beta
  ENSP ID: ENSP00000417329
MCFSFIMPPAMADILDIWAVDSQIASDGSIPVDFLLPTGIYIQLEVPREATISYIK

SEQ ID NO: 62733 - protein, 702 aa, Homo sapiens
  Payload ID: 12527
  Gene Symbol: PIK3CB
  Gene Name: phosphatidylinositol-4,5-bisphosphate 3-kinase, catalytic subunit beta
  ENSP ID: ENSP00000417869
  MOD_RES (1)..(1): Any amino acid
XVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 62734 - protein, 1070 aa, Homo sapiens; identical to SEQ ID NO: 62731
  Payload ID: 12527
  Gene Symbol: PIK3CB
  Gene Name: phosphatidylinositol-4,5-bisphosphate 3-kinase, catalytic subunit beta
  Uniprot ID: P42338
  ENSP ID: ENSP00000418143

SEQ ID NO: 62735 - protein, 181 aa, Homo sapiens
  Payload ID: 12527
  Gene Symbol: PIK3CB
  Gene Name: phosphatidylinositol-4,5-bisphosphate 3-kinase, catalytic subunit beta
  ENSP ID: ENSP00000418834
  MOD_RES (1)..(1): Any amino acid
XLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQHVWENNNPFQIVLVKGNKLNTEETVKVHVRAGLFHGTELLCKTIVS

SEQ ID NO: 62736 - protein, 245 aa, Homo sapiens
  Payload ID: 12527
  Gene Symbol: PIK3CB
  Gene Name: phosphatidylinositol-4,5-bisphosphate 3-kinase, catalytic subunit beta
  ENSP ID: ENSP00000419091
LRTGDIILHSWSSFPDELEEMLNPMGTVQTNPYTENATALHVKFPENKKQPYYYPPFDKSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQC

SEQ ID NO: 62737 - protein, 34 aa, Homo sapiens
  Payload ID: 12527
  Gene Symbol: PIK3CB
  Gene Name: phosphatidylinositol-4,5-bisphosphate 3-kinase, catalytic subunit beta
  ENSP ID: ENSP00000419513
HYPVAWVNTMVFDFKGQLRTGDIILHSWSSFPDY

SEQ ID NO: 62738 - protein, 131 aa, Homo sapiens
  Payload ID: 12527
  Gene Symbol: PIK3CB
  Gene Name: phosphatidylinositol-4,5-bisphosphate 3-kinase, catalytic subunit beta
  ENSP ID: ENSP00000419857
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIG

SEQ ID NO: 62739 - protein, 134 aa, Homo sapiens
  Payload ID: 12527
  Gene Symbol: PIK3CB
  Gene Name: phosphatidylinositol-4,5-bisphosphate 3-kinase, catalytic subunit beta
  ENSP ID: ENSP00000420108
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGS

SEQ ID NO: 62740 - protein, 100 aa, Homo sapiens
  Payload ID: 12527
  Gene Symbol: PIK3CB
  Gene Name: phosphatidylinositol-4,5-bisphosphate 3-kinase, catalytic subunit beta
  ENSP ID: ENSP00000420399
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLC

SEQ ID NO: 62741 - protein, 521 aa, Homo sapiens
  Payload ID: 12527
  Gene Symbol: PIK3CB
  Gene Name: phosphatidylinositol-4,5-bisphosphate 3-kinase, catalytic subunit beta
  ENSP ID: ENSP00000438259
MDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDVCFPLDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 62742 - protein, 1068 aa, Homo sapiens
  Payload ID: 12528
  Gene Symbol: PIK3CD
  Gene Name: phosphatidylinositol-4,5-bisphosphate 3-kinase, catalytic subunit delta
  ENSP ID: ENSP00000354410
MPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLIGKGLHEFDSLCDPEVNDFRAKMCQFCEEAAARRQQLGWEAWLQYSFPLQLEPSAQTWGPGTLRLPNRALLVNVKFEGSEESFTFQVSTKDVPLALMACALRKKATVFRQPLVEQPEDYTLQVNGRHEYLYGSYPLCQFQVQKPRAKPPPIPAKKPSSVSLWSLEQPFRIELIQGSKVNADERMKLVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKLPGGMLLASREWRPELLWMRLHAEDSAPSRMIGVAMPGLGVLPGLVQAPGDAECSRLLQILELGRHSECVHVTEEEQLQLREILERRGSGELYEHEKDLVWKLRHEVQEHFPEALARLLLVTKWNKHEDVAQMLYLLCSWPELPVLSALELLDFSFPDCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYSNEEAGSGGSVGIIFKNGDDLRQDMLTLQMIQLMDVLWKQEGLDLRMTPYGCLPTGDRTGLIEVVLRSDTIANIQLNKSNMAATAAFNKDALLNWLKSKNPGEALDRAIEEFTLSCAGYCVATYVLGIGDRHSDNIMIRESGQLFHIDFGHFLGNFKTKFGINRERVPFILTYDFVHVIQQGKTNNSEKFERFRGYCERAYTILRRHGLLFLHLFALMRAAGLPELSCSKDIQYLKDSLALGKTEEEALKHFRVKFNEALRESWKTKVNWLAHNVSKDNRQ

SEQ ID NO: 62743 - protein, 1044 aa, Homo sapiens
  Payload ID: 12528
  Gene Symbol: PIK3CD
  Gene Name: phosphatidylinositol-4,5-bisphosphate 3-kinase, catalytic subunit delta
  Uniprot ID: O00329
  ENSP ID: ENSP00000366563
MPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLIGKGLHEFDSLCDPEVNDFRAKMCQFCEEAAARRQQLGWEAWLQYSFPLQLEPSAQTWGPGTLRLPNRALLVNVKFEGSEESFTFQVSTKDVPLALMACALRKKATVFRQPLVEQPEDYTLQVNGRHEYLYGSYPLCQFQYICSCLHSGLTPHLTMVHSSSILAMRDEQSNPAPQVQKPRAKPPPIPAKKPSSVSLWSLEQPFRIELIQGSKVNADERMKLVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKILELGRHSECVHVTEEEQLQLREILERRGSGELYEHEKDLVWKLRHEVQEHFPEALARLLLVTKWNKHEDVAQMLYLLCSWPELPVLSALELLDFSFPDCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYSNEEAGSGGSVGIIFKNGDDLRQDMLTLQMIQLMDVLWKQEGLDLRMTPYGCLPTGDRTGLIEVVLRSDTIANIQLNKSNMAATAAFNKDALLNWLKSKNPGEALDRAIEEFTLSCAGYCVATYVLGIGDRHSDNIMIRESGQLFHIDFGHFLGNFKTKFGINRERVPFILTYDFVHVIQQGKTNNSEKFERFRGYCERAYTILRRHGLLFLHLFALMRAAGLPELSCSKDIQYLKDSLALGKTEEEALKHFRVKFNEALRESWKTKVNWLAHNVSKDNRQ

SEQ ID NO: 62744 - protein, 1068 aa, Homo sapiens
  Payload ID: 12528
  Gene Symbol: PIK3CD
  Gene Name: phosphatidylinositol-4,5-bisphosphate 3-kinase, catalytic subunit delta
  ENSP ID: ENSP00000443811
MPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLIGKGLHEFDSLCDPEVNDFRAKMCQFCEEAAARRQQLGWEAWLQYSFPLQLEPSAQTWGPGTLRLPNRALLVNVKFEGSEESFTFQVSTKDVPLALMACALRKKATVFRQPLVEQPEDYTLQVNGRHEYLYGSYPLCQFQVQKPRAKPPPIPAKKPSSVSLWSLEQPFRIELIQGSKVNADERMKLVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKLPGGMLLASREWRPELLWMRLHAEDSAPSRMIGVAMPGLGVLPGLVQAPGDAECSRLLQILELGRHSECVHVTEEEQLQLREILERRGSGELYEHEKDLVWKLRHEVQEHFPEALARLLLVTKWNKHEDVAQDALPAVSWPELPVLSALELLDFSFPDCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYSNEEAGSGGSVGIIFKNGDDLRQDMLTLQMIQLMDVLWKQEGLDLRMTPYGCLPTGDRTGLIEVVLRSDTIANIQLNKSNMAATAAFNKDALLNWLKSKNPGEALDRAIEEFTLSCAGYCVATYVLGIGDRHSDNIMIRESGQLFHIDFGHFLGNFKTKFGINRERVPFILTYDFVHVIQQGKTNNSEKFERFRGYCERAYTILRRHGLLFLHLFALMRAAGLPELSCSKDIQYLKDSLALGKTEEEALKHFRVKFNEALRESWKTKVNWLAHNVSKDNRQ

SEQ ID NO: 62745 - protein, 1068 aa, Homo sapiens; identical to SEQ ID NO: 62744
  Payload ID: 12528
  Gene Symbol: PIK3CD
  Gene Name: phosphatidylinositol-4,5-bisphosphate 3-kinase, catalytic subunit delta
  ENSP ID: ENSP00000446444

SEQ ID NO: 62746 - protein, 1068 aa, Homo sapiens; identical to SEQ ID NO: 62742
  Payload ID: 12528
  Gene Symbol: PIK3CD
  Gene Name: phosphatidylinositol-4,5-bisphosphate 3-kinase, catalytic subunit delta
  ENSP ID: ENSP00000486826

SEQ ID NO: 62747 - protein, 1102 aa, Homo sapiens
  Payload ID: 12529
  Gene Symbol: PIK3CG
  Gene Name: phosphatidylinositol-4,5-bisphosphate 3-kinase, catalytic subunit gamma
  Uniprot ID: P48736
  ENSP ID: ENSP00000352121
MELENYKQPVVLREDNCRRRRRMKPRSAAASLSSMELIPIEFVLPTSQRKCKSPETALLHVAGHGNVEQMKAQVWLRALETSVAADFYHRLGPHHFLLLYQKKGQWYEIYDKYQVVQTLDCLRYWKATHRSPGQIHLVQRHPPSEESQAFQRQLTALIGYDVTDVSNVHDDELEFTRRGLVTPRMAEVASRDPKLYAMHPWVTSKPLPEYLWKKIANNCIFIVIHRSTTSQTIKVSPDDTPGAILQSFFTKMAKKKSLMDIPESQSEQDFVLRVCGRDEYLVGETPIKNFQWVRHCLKNGEEIHVVLDTPPDPALDEVRKEEWPLVDDCTGVTGYHEQLTIHGKDHESVFTVSLWDCDRKFRVKIRGIDIPVLPRNTDLTVFVEANIQHGQQVLCQRRTSPKPFTEEVLWNVWLEFSIKIKDLPKGALLNLQIYCGKAPALSSKASAESPSSESKGKVQLLYYVNLLLIDHRFLLRRGEYVLHMWQISGKGEDQGSFNADKLTSATNPDKENSMSISILLDNYCHPIALPKHQPTPDPEGDRVRAEMPNQLRKQLEAIIATDPLNPLTAEDKELLWHFRYESLKHPKAYPKLFSSVKWGQQEIVAKTYQLLARREVWDQSALDVGLTMQLLDCNFSDENVRAIAVQKLESLEDDDVLHYLLQLVQAVKFEPYHDSALARFLLKRGLRNKRIGHFLFWFLRSEIAQSRHYQQRFAVILEAYLRGCGTAMLHDFTQQVQVIEMLQKVTLDIKSLSAEKYDVSSQVISQLKQKLENLQNSQLPESFRVPYDPGLKAGALAIEKCKVMASKKKPLWLEFKCADPTALSNETIGIIFKHGDDLRQDMLILQILRIMESIWETESLDLCLLPYGCISTGDKIGMIEIVKDATTIAKIQQSTVGNTGAFKDEVLNHWLKEKSPTEEKFQAAVERFVYSCAGYCVATFVLGIGDRHNDNIMITETGNLFHIDFGHILGNYKSFLGINKERVPFVLTPDFLFVMGTSGKKTSPHFQKFQDICVKAYLALRHHTNLLIILFSMMLMTGMPQLTSKEDIEYIRDALTVGKNEEDAKKYFLDQIEVCRDKGWTVQFNWFLHLVLGIKQGEKHSA

SEQ ID NO: 62748 - protein, 1102 aa, Homo sapiens; identical to SEQ ID NO: 62747
  Payload ID: 12529
  Gene Symbol: PIK3CG
  Gene Name: phosphatidylinositol-4,5-bisphosphate 3-kinase, catalytic subunit gamma
  Uniprot ID: P48736
  ENSP ID: ENSP00000392258

SEQ ID NO: 62749 - protein, 182 aa, Homo sapiens
  Payload ID: 12529
  Gene Symbol: PIK3CG
  Gene Name: phosphatidylinositol-4,5-bisphosphate 3-kinase, catalytic subunit gamma
  ENSP ID: ENSP00000417623
MLHDFTQQVQVIEMLQKVTLDIKSLSAEKYDVSSQVISQLKQKLENLQNSQLPESFRVPYDPGLKAGALAIEKCKVMASKKKPLWLEFKCADPTALSNETIGIIFKHGDDLRQDMLILQILRIMESIWETESLDLCLLPYGCISTGDKIGMIEIVKDATTIAKIQQSTVGNTGAFKDEVLNH

SEQ ID NO: 62750 - protein, 1102 aa, Homo sapiens; identical to SEQ ID NO: 62747
  Payload ID: 12529
  Gene Symbol: PIK3CG
  Gene Name: phosphatidylinositol-4,5-bisphosphate 3-kinase, catalytic subunit gamma
  Uniprot ID: P48736
  ENSP ID: ENSP00000419260

SEQ ID NO: 62751 - protein, 1686 aa, Homo sapiens
  Payload ID: 12530
  Gene Symbol: PIK3C2A
  Gene Name: phosphatidylinositol-4-phosphate 3-kinase, catalytic subunit type 2 alpha
  Uniprot ID: O00443
  ENSP ID: ENSP00000265970
MAQISSNSGFKECPSSHPEPTRAKDVDKEEALQMEAEALAKLQKDRQVTDNQRGFELSSSTRKKAQVYNKQDYDLMVFPESDSQKRALDIDVEKLTQAELEKLLLDDSFETKKTPVLPVTPILSPSFSAQLYFRPTIQRGQWPPGLPGPSTYALPSIYPSTYSKQAAFQNGFNPRMPTFPSTEPIYLSLPGQSPYFSYPLTPATPFHPQGSLPIYRPVVSTDMAKLFDKIASTSEFLKNGKARTDLEITDSKVSNLQVSPKSEDISKFDWLDLDPLSKPKVDNVEVLDHEEEKNVSSLLAKDPWDAVLLEERSTANCHLERKVNGKSLSVATVTRSQSLNIRTTQLAKAQGHISQKDPNGTSSLPTGSSLLQEVEVQNEEMAAFCRSITKLKTKFPYTNHRTNPGYLLSPVTAQRNICGENASVKVSIDIEGFQLPVTFTCDVSSTVEIIIMQALCWVHDDLNQVDVGSYVLKVCGQEEVLQNNHCLGSHEHIQNCRKWDTEIRLQLLTFSAMCQNLARTAEDDETPVDLNKHLYQIEKPCKEAMTRHPVEELLDSYHNQVELALQIENQHRAVDQVIKAVRKICSALDGVETLAITESVKKLKRAVNLPRSKTADVTSLFGGEDTSRSSTRGSLNPENPVQVSINQLTAAIYDLLRLHANSGRSPTDCAQSSKSVKEAWTTTEQLQFTIFAAHGISSNWVSNYEKYYLICSLSHNGKDLFKPIQSKKVGTYKNFFYLIKWDELIIFPIQISQLPLESVLHLTLFGILNQSSGSSPDSNKQRKGPEALGKVSLPLFDFKRFLTCGTKLLYLWTSSHTNSVPGTVTKKGYVMERIVLQVDFPSPAFDIIYTTPQVDRSIIQQHNLETLENDIKGKLLDILHKDSSLGLSKEDKAFLWEKRYYCFKHPNCLPKILASAPNWKWVNLAKTYSLLHQWPALYPLIALELLDSKFADQEVRSLAVTWIEAISDDELTDLLPQFVQALKYEIYLNSSLVQFLLSRALGNIQIAHNLYWLLKDALHDVQFSTRYEHVLGALLSVGGKRLREELLKQTKLVQLLGGVAEKVRQASGSARQVVLQRSMERVQSFFQKNKCRLPLKPSLVAKELNIKSCSFFSSNAVPLKVTMVNADPMGEEINVMFKVGEDLRQDMLALQMIKIMDKIWLKEGLDLRMVIFKCLSTGRDRGMVELVPASDTLRKIQVEYGVTGSFKDKPLAEWLRKYNPSEEEYEKASENFIYSCAGCCVATYVLGICDRHNDNIMLRSTGHMFHIDFGKFLGHAQMFGSFKRDRAPFVLTSDMAYVINGGEKPTIRFQLFVDLCCQAYNLIRKQTNLFLNLLSLMIPSGLPELTSIQDLKYVRDALQPQTTDAEATIFFTRLIESSLGSIATKFNFFIHNLAQLRFSGLPSNDEPILSFSPKTYSFRQDGRIKEVSVFTYHKKYNPDKHYIYVVRILREGQIEPSFVFRTFDEFQELHNKLSIIFPLWKLPGFPNRMVLGRTHIKDVAAKRKIELNSYLQSLMNASTDVAECDLVCTFFHPLLRDEKAEGIARSADAGSFSPTPGQIGGAVKLSISYRNGTLFIMVMHIKDLVTEDGADPNPYVKTYLLPDNHKTSKRKTKISRKTRNPTFNEMLVYSGYSKETLRQRELQLSVLSAESLRENFFLGGVTLPLKDFNLSKETVKWYQLTAATYL

SEQ ID NO: 62752 - protein, 483 aa, Homo sapiens
  Payload ID: 12530
  Gene Symbol: PIK3C2A
  Gene Name: phosphatidylinositol-4-phosphate 3-kinase, catalytic subunit type 2 alpha
  ENSP ID: ENSP00000436244
MAQISSNSGFKECPSSHPEPTRAKDVDKEEALQMEAEALAKLQKDRQVTDNQRGFELSSSTRKKAQVYNKQDYDLMVFPESDSQKRALDIDVEKLTQAELEKLLLDDSFETKKTPVLPVTPILSPSFSAQLYFRPTIQRGQWPPGLPGPSTYALPSIYPSTYSKQAAFQNGFNPRMPTFPSTEPIYLSLPGQSPYFSYPLTPATPFHPQGSLPIYRPVVSTDMAKLFDKIASTSEFLKNGKARTDLEITDSKVSNLQVSPKSEDISKFDWLDLDPLSKPKVDNVEVLDHEEEKNVSSLLAKDPWDAVLLEERSTANCHLERKVNGKSLSVATVTRSQSLNIRTTQLAKAQGHISQKDPNGTSSLPTGSSLLQEVEVQNEEMAAFCRSITKLKTKFPYTNHRTNPGYLLSPVTAQRNICGENASVKVSIDIEGFQLPVTFTCDVSSTVEIIIMQALCWVHDDLNQVDVGSYVLKVCGQEEVLQK

SEQ ID NO: 62753 - protein, 130 aa, Homo sapiens
  Payload ID: 12530
  Gene Symbol: PIK3C2A
  Gene Name: phosphatidylinositol-4-phosphate 3-kinase, catalytic subunit type 2 alpha
  ENSP ID: ENSP00000436969
MAQISSNSGFKECPSSHPEPTRAKDVDKEEALQMEAEALAKLQKDRQVTDNQRGFELSSSTRKKAQVYNKQDYDLMVFPESDSQKRALDIDVEKLTQAELEKLLLDDSFETKKTPVLPVTPILSPSFSAQ

SEQ ID NO: 62754 - protein, 173 aa, Homo sapiens
  Payload ID: 12531
  Gene Symbol: PIK3C2B
  Gene Name: phosphatidylinositol-4-phosphate 3-kinase, catalytic subunit type 2 beta
  ENSP ID: ENSP00000356152
MRPWSSPAQLVAGAQPAGRGDPLGPRPIPPPRFRRASSQREPPYPRPAEPALELAGSKCQPDTPAASLCPADSPSQHRVMPPGPASWANVGSRPHTVANGHELFEVSEERDEEVAAFCHMLDILRSGSDIQDYFLTGYVWSAVTPSPEHLGDEVNLKVTVLCDRLQEALTFTC

SEQ ID NO: 62755 - protein, 1634 aa, Homo sapiens
  Payload ID: 12531
  Gene Symbol: PIK3C2B
  Gene Name: phosphatidylinositol-4-phosphate 3-kinase, catalytic subunit type 2 beta
  Uniprot ID: O00750
  ENSP ID: ENSP00000356155
MSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIFDGSDGGVSSSPGPGDIEGSCKKLSPPPLPPRASIWDTPPLPPRKGSPSSSKISQPSDINTFSLVEQLPGKLLEHRILEEEEVLGGGGQGRLLGSVDYDGINDAITRLNLKSTYDAEMLRDATRGWKEGRGPLDFSKDTSGKPVARSKTMPPQVPPRTYASRYGNRKNATPGKNRRISAAPVGSRPHTVANGHELFEVSEERDEEVAAFCHMLDILRSGSDIQDYFLTGYVWSAVTPSPEHLGDEVNLKVTVLCDRLQEALTFTCNCSSTVDLLIYQTLCYTHDDLRNVDVGDFVLKPCGLEEFLQNKHALGSHEYIQYCRKFDIDIRLQLMEQKVVRSDLARTVNDDQSPSTLNYLVHLQERPVKQTISRQALSLLFDTYHNEVDAFLLADGDFPLKADRVVQSVKAICNALAAVETPEITSALNQLPPCPSRMQPKIQKDPSVLAVRENREKVVEALTAAILDLVELYCNTFNADFQTAVPGSRKHDLVQEACHFARSLAFTVYATHRIPIIWATSYEDFYLSCSLSHGGKELCSPLQTRRAHFSKYLFHLIVWDQQICFPVQVNRLPRETLLCATLYALPIPPPGSSSEANKQRRVPEALGWVTTPLFNFRQVLTCGRKLLGLWPATQENPSARWSAPNFHQPDSVILQIDFPTSAFDIKFTSPPGDKFSPRYEFGSLREEDQRKLKDIMQKESLYWLTDADKKRLWEKRYYCHSEVSSLPLVLASAPSWEWACLPDIYVLLKQWTHMNHQDALGLLHATFPDQEVRRMAVQWIGSLSDAELLDYLPQLVQALKYECYLDSPLVRFLLKRAVSDLRVTHYFFWLLKDGLKDSQFSIRYQYLLAALLCCCGKGLREEFNRQCWLVNALAKLAQQVREAAPSARQGILRTGLEEVKQFFALNGSCRLPLSPSLLVKGIVPRDCSYFNSNAVPLKLSFQNVDPLGENIRVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQMKFTGSDDRLTLSFASRTHTLKSSGRISDVFLCRHEKIFHPNKGYIYVVKVMRENTHEATYIQRTFEEFQELHNKLRLLFPSSHLPSFPSRFVIGRSRGEAVAERRREELNGYIWHLIHAPPEVAECDLVYTFFHPLPRDEKAMGTSPAPKSSDGTWARPVGKVGGEVKLSISYKNNKLFIMVMHIRGLQLLQDGNDPDPYVKIYLLPDPQKTTKRKTKVARKTCNPTYNEMLVYDGIPKGDLQQRELQLSVLSEQGFWENVLLGEVNIRLRELDLAQEKTGWFALGSRSHGTL

SEQ ID NO: 62756 - protein, 1606 aa, Homo sapiens
  Payload ID: 12531
  Gene Symbol: PIK3C2B
  Gene Name: phosphatidylinositol-4-phosphate 3-kinase, catalytic subunit type 2 beta
  ENSP ID: ENSP00000400561
MSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIFDGSDGGVSSSPGPGDIEGSCKKLSPPPLPPRASIWDTPPLPPRKGSPSSSKISQPSDINTFSLVEQLPGKLLEHRILEEEEVLGGGGQGRLLGSVDYDGINDAITRLNLKSTYDAEMLRDATRGWKEGRGPLDFSKDTSGKPVARSKTMPPQVPPRTYASRYGNRKNATPGKNRRISAAPVGSRPHTVANGHELFEVSEERDEEVAAFCHMLDILRSGSDIQDYFLTGYVWSAVTPSPEHLGDEVNLKVTVLCDRLQEALTFTCNCSSTVDLLIYQTLCYTHDDLRNVDVGDFVLKPCGLEEFLQNKHALGSHEYIQYCRKFDIDIRLQLMEQKVVRSDLARTVNDDQSPSTLNYLVHLQERPVKQTISRQALSLLFDTYHNEVDAFLLADGDFPLKADRVVQSVKAICNALAAVETPEITSALNQLPPCPSRMQPKIQKDPSVLAVRENREKVVEALTAAILDLVELYCNTFNADFQTAVPGSRKHDLVQEACHFARSLAFTVYATHRIPIIWATSYEDFYLSCSLSHGGKELCSPLQTRRAHFSKYLFHLIVWDQQICFPVQVNRLPRETLLCATLYALPIPPPGSSSEANKQRRVPEALGWVTTPLFNFRQVLTCGRKLLGLWPATQENPSARWSAPNFHQPDSVILQIDFPTSAFDIKFTSPPGDKFSPRYEFGSLREEDQRKLKDIMQKESLYWLTDADKKRLWEKRYYCHSEWTHMNHQDALGLLHATFPDQEVRRMAVQWIGSLSDAELLDYLPQLVQALKYECYLDSPLVRFLLKRAVSDLRVTHYFFWLLKDGLKDSQFSIRYQYLLAALLCCCGKGLREEFNRQCWLVNALAKLAQQVREAAPSARQGILRTGLEEVKQFFALNGSCRLPLSPSLLVKGIVPRDCSYFNSNAVPLKLSFQNVDPLGENIRVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQMKFTGSDDRLTLSFASRTHTLKSSGRISDVFLCRHEKIFHPNKGYIYVVKVMRENTHEATYIQRTFEEFQELHNKLRLLFPSSHLPSFPSRFVIGRSRGEAVAERRREELNGYIWHLIHAPPEVAECDLVYTFFHPLPRDEKAMGTSPAPKSSDGTWARPVGKVGGEVKLSISYKNNKLFIMVMHIRGLQLLQDGNDPDPYVKIYLLPDPQKTTKRKTKVARKTCNPTYNEMLVYDGIPKGDLQQRELQLSVLSEQGFWENVLLGEVNIRLRELDLAQEKTGWFALGSRSHGTL

SEQ ID NO: 62757 - protein, 131 aa, Homo sapiens
  Payload ID: 12531
  Gene Symbol: PIK3C2B
  Gene Name: phosphatidylinositol-4-phosphate 3-kinase, catalytic subunit type 2 beta
  ENSP ID: ENSP00000401795
MSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIF

SEQ ID NO: 62758 - protein, 60 aa, Homo sapiens
  Payload ID: 12531
  Gene Symbol: PIK3C2B
  Gene Name: phosphatidylinositol-4-phosphate 3-kinase, catalytic subunit type 2 beta
  ENSP ID: ENSP00000409554
MSSTQGNGEHWKSLESVGISRKELAMAEALQMEYDALSRLRHDKEENRAKQNADPSLISW

SEQ ID NO: 62759 - protein, 1445 aa, Homo sapiens
  Payload ID: 12532
  Gene Symbol: PIK3C2G
  Gene Name: phosphatidylinositol-4-phosphate 3-kinase, catalytic subunit type 2 gamma
  Uniprot ID: O75747
  ENSP ID: ENSP00000266497
MAYSWQTDPNPNESHEKQYEHQEFLFVNQPHSSSQVSLGFDQIVDEISGKIPHYESEIDENTFFVPTAPKWDSTGHSLNEAHQISLNEFTSKSRELSWHQVSKAPAIGFSPSVLPKPQNTNKECSWGSPIGKHHGADDSRFSILAPSFTSLDKINLEKELENENHNYHIGFESSIPPTNSSFSSDFMPKEENKRSGHVNIVEPSLMLLKGSLQPGMWESTWQKNIESIGCSIQLVEVPQSSNTSLASFCNKVKKIRERYHAADVNFNSGKIWSTTTAFPYQLFSKTKFNIHIFIDNSTQPLHFMPCANYLVKDLIAEILHFCTNDQLLPKDHILSVCGSEEFLQNDHCLGSHKMFQKDKSVIQLHLQKSREAPGKLSRKHEEDHSQFYLNQLLEFMHIWKVSRQCLLTLIRKYDFHLKYLLKTQENVYNIIEEVKKICSVLGCVETKQITDAVNELSLILQRKGENFYQSSETSAKGLIEKVTTELSTSIYQLINVYCNSFYADFQPVNVPRCTSYLNPGLPSHLSFTVYAAHNIPETWVHRINFPLEIKSLPRESMLTVKLFGIACATNNANLLAWTCLPLFPKEKSILGSMLFSMTLQSEPPVEMITPGVWDVSQPSPVTLQIDFPATGWEYMKPDSEENRSNLEEPLKECIKHIARLSQKQTPLLLSEEKKRYLWFYRFYCNNENCSLPLVLGSAPGWDERTVSEMHTILRRWTFSQPLEALGLLTSSFPDQEIRKVAVQQLDNLLNDELLEYLPQLVQAVKFEWNLESPLVQLLLHRSLQSIQVAHRLYWLLKNAENEAYFKSWYQKLLAALQFCAGKALNDEFSKEQKLIKILGDIGERVKSASDHQRQEVLKKEIGRLEEFFQDVNTCHLPLNPALCIKGIDHDACSYFTSNALPLKITFINANPMGKNISIIFKAGDDLRQDMLVLQLIQVMDNIWLQEGLDMQMIIYRCLSTGKDQGLVQMVPDAVTLAKIHRHSGLIGPLKENTIKKWFSQHNHLKADYEKALRNFFYSCAGWCVVTFILGVCDRHNDNIMLTKSGHMFHIDFGKFLGHAQTFGGIKRDRAPFIFTSEMEYFITEGGKNPQHFQDFVELCCRAYNIIRKHSQLLLNLLEMMLYAGLPELSGIQDLKYVYNNLRPQDTDLEATSHFTKKIKESLECFPVKLNNLIHTLAQMSAISPAKSTSQTFPQESCLLSTTRSIERATILGFSKKSSNLYLIQVTHSNNETSLTEKSFEQFSKLHSQLQKQFASLTLPEFPHWWHLPFTNSDHRRFRDLNHYMEQILNVSHEVTNSDCVLSFFLSEAVQQTVEESSPVYLGEKFPDKKPKVQLVISYEDVKLTILVKHMKNIHLPDGSAPSAHVEFYLLPYPSEVRRRKTKSVPKCTDPTYNEIVVYDEVTELQGHVLMLIVKSKTVFVGAINIRLCSVPLDKEKWYPLGNSII

SEQ ID NO: 62760 - protein, 1445 aa, Homo sapiens; identical to SEQ ID NO: 62759
  Payload ID: 12532
  Gene Symbol: PIK3C2G
  Gene Name: phosphatidylinositol-4-phosphate 3-kinase, catalytic subunit type 2 gamma
  Uniprot ID: O75747
  ENSP ID: ENSP00000404845

SEQ ID NO: 62761 - protein, 231 aa, Homo sapiens
  Payload ID: 12532
  Gene Symbol: PIK3C2G
  Gene Name: phosphatidylinositol-4-phosphate 3-kinase, catalytic subunit type 2 gamma
  ENSP ID: ENSP00000441618
MAYSWQTDPNPNESHEKQYEHQEFLFVNQPHSSSQVSLGFDQIVDEISGKIPHYESEIDENTFFVPTAPKWDSTGHSLNEAHQISLNEFTSKSRELSWHQVSKAPAIGFSPSVLPKPQNTNKECSWGSPIGKHHGADDSRFSILAPSFTSLDKINLEKELENENHNYHIGFESSIPPTNSSFSSDFMPKEENKRSGHVNIVEPSLMLLKGSLQPGMWESTWQKNIEVVPFS

SEQ ID NO: 62762 - protein, 583 aa, Homo sapiens
  Payload ID: 12532
  Gene Symbol: PIK3C2G
  Gene Name: phosphatidylinositol-4-phosphate 3-kinase, catalytic subunit type 2 gamma
  ENSP ID: ENSP00000443850
MAYSWQTDPNPNESHEKQYEHQEFLFVNQPHSSSQVSLGFDQIVDEISGKIPHYESEIDENTFFVPTAPKWDSTGHSLNEAHQISLNEFTSKSRELSWHQVSKAPAIGFSPSVLPKPQNTNKECSWGSPIGKHHGADDSRFSILAPSFTSLDKINLEKELENENHNYHIGFESSIPPTNSSFSSDFMPKEENKRSGHVNIVEPSLMLLKGSLQPGMWESTWQKNIESIGCSIQLVEVPQSSNTSLASFCNKVKKIRERYHAADVNFNSGKIWSTTTAFPYQLFSKTKFNIHIFIDNSTQPLHFMPCANYLVKDLIAEILHFCTNDQLLPKDHILSVCGSEEFLQNDHCLGSHKMFQKDKSVIQLHLQKSREAPGKLSRKHEEDHSQFYLNQLLEFMHIWKVSRQCLLTLIRKYDFHLKYLLKTQENVYNIIEEVKKICSVLGCVETKQITDAVNELSLILQRKGENFYQSSETSAKGLIEKVTTELSTSIYQLINVYCNSFYADFQPVNVPRCTSYLNPGLPSHLSFTVYAAHNIPETWVHSYKAFSFTCWLTYAGKKLCQVRNYRNIPDKKLFFFLVNWNET

SEQ ID NO: 62763 - protein, 1486 aa, Homo sapiens
  Payload ID: 12532
  Gene Symbol: PIK3C2G
  Gene Name: phosphatidylinositol-4-phosphate 3-kinase, catalytic subunit type 2 gamma
  ENSP ID: ENSP00000445381
MAYSWQTDPNPNESHEKQYEHQEFLFVNQPHSSSQVSLGFDQIVDEISGKIPHYESEIDENTFFVPTAPKWDSTGHSLNEAHQISLNEFTSKSRELSWHQVSKAPAIGFSPSVLPKPQNTNKECSWGSPIGKHHGADDSRFSILAPSFTSLDKINLEKELENENHNYHIGFESSIPPTNSSFSSDFMPKEENKRSGHVNIVEPSLMLLKGSLQPGMWESTWQKNIESIGCSIQLVEVPQSSNTSLASFCNKVKKIRERYHAADVNFNSGKIWSTTTAFPYQLFSKTKFNIHIFIDNSTQPLHFMPCANYLVKDLIAEILHFCTNDQLLPKDHILSVCGSEEFLQNDHCLGSHKMFQKDKSVIQLHLQKSREAPGKLSRKHEEDHSQFYLNQLLEFMHIWKVSRQCLLTLIRKYDFHLKYLLKTQENVYNIIEEVKKICSVLGCVETKQITDAVNELSLILQRKGENFYQSSETSAKGLIEKVTTELSTSIYQLINVYCNSFYADFQPVNVPRCTSYLNPGLPSHLSFTVYAAHNIPETWVHSYKAFSFTCWLTYAGKKLCQVRNYRNIPDKKLFFFLVNWNETINFPLEIKSLPRESMLTVKLFGIACATNNANLLAWTCLPLFPKEKSILGSMLFSMTLQSEPPVEMITPGVWDVSQPSPVTLQIDFPATGWEYMKPDSEENRSNLEEPLKECIKHIARLSQKQTPLLLSEEKKRYLWFYRFYCNNENCSLPLVLGSAPGWDERTVSEMHTILRRWTFSQPLEALGLLTSSFPDQEIRKVAVQQLDNLLNDELLEYLPQLVQAVKFEWNLESPLVQLLLHRSLQSIQVAHRLYWLLKNAENEAYFKSWYQKLLAALQFCAGKALNDEFSKEQKLIKILGDIGERVKSASDHQRQEVLKKEIGRLEEFFQDVNTCHLPLNPALCIKGIDHDACSYFTSNALPLKITFINANPMGKNISIIFKAGDDLRQDMLVLQLIQVMDNIWLQEGLDMQMIIYRCLSTGKDQGLVQMVPDAVTLAKIHRHSGLIGPLKENTIKKWFSQHNHLKADYEKALRNFFYSCAGWCVVTFILGVCDRHNDNIMLTKSGHMFHIDFGKFLGHAQTFGGIKRDRAPFIFTSEMEYFITEGGKNPQHFQDFVELCCRAYNIIRKHSQLLLNLLEMMLYAGLPELSGIQDLKYVYNNLRPQDTDLEATSHFTKKIKESLECFPVKLNNLIHTLAQMSAISPAKSTSQTFPQESCLLSTTRSIERATILGFSKKSSNLYLIQVTHSNNETSLTEKSFEQFSKLHSQLQKQFASLTLPEFPHWWHLPFTNSDHRRFRDLNHYMEQILNVSHEVTNSDCVLSFFLSEAVQQTVEESSPVYLGEKFPDKKPKVQLVISYEDVKLTILVKHMKNIHLPDGSAPSAHVEFYLLPYPSEVRRRKTKSVPKCTDPTYNEIVVYDEVTELQGHVLMLIVKSKTVFVGAINIRLCSVPLDKEKWYPLGNSII

SEQ ID NO: 62764 - protein, 187 aa, Homo sapiens
  Payload ID: 12532
  Gene Symbol: PIK3C2G
  Gene Name: phosphatidylinositol-4-phosphate 3-kinase, catalytic subunit type 2 gamma
  ENSP ID: ENSP00000479145
  MOD_RES (1)..(1): Any amino acid
XGSLQPGMWESTWQKNIESIGCSIQLVEVPQSSNTSLASFCNKVKKIRERYHAADVNFNSGKIWSTTTAFPYQLFSKTKFNIHIFIDNSTQPLHFMPCANYLVKDLIAEILHFCTNDQLLPKDHILSVCGSEEFLQNDHCLGSHKMFQKDKSVIQLHLQKSREAPGKLSRKVRTQQEGSCLHTGKGL

SEQ ID NO: 62765 - protein, 549 aa, Homo sapiens
  Payload ID: 12533
  Gene Symbol: PIP5K1A
  Gene Name: phosphatidylinositol-4-phosphate 5-kinase, type I, alpha
  Uniprot ID: Q99755
  ENSP ID: ENSP00000271663
MASASSGPSSSVGFSSFDPAVPSCTLSSASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 62766 - protein, 562 aa, Homo sapiens
  Payload ID: 12533
  Gene Symbol: PIP5K1A
  Gene Name: phosphatidylinositol-4-phosphate 5-kinase, type I, alpha
  Uniprot ID: Q99755
  ENSP ID: ENSP00000357883
MASASSGPSSSVGFSSFDPAVPSCTLSSAASGIKRPMASEVLEARQDSYISLVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 62767 - protein, 500 aa, Homo sapiens
  Payload ID: 12533
  Gene Symbol: PIP5K1A
  Gene Name: phosphatidylinositol-4-phosphate 5-kinase, type I, alpha
  Uniprot ID: Q99755
  ENSP ID: ENSP00000357885
MASASSGPSSSVGFSSFDPAVPSCTLSSASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPCVHLGRPDVLPQTPPLEEISEGSPIPDPSFSPLVGETLQMLTTSTTLEKLEVAESEFTH

SEQ ID NO: 62768 - protein, 550 aa, Homo sapiens
  Payload ID: 12533
  Gene Symbol: PIP5K1A
  Gene Name: phosphatidylinositol-4-phosphate 5-kinase, type I, alpha
  ENSP ID: ENSP00000386432
MASASSGPSSSVGFSSFDPAVPSCTLSSAASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 62769 - protein, 41 aa, Homo sapiens
  Payload ID: 12533
  Gene Symbol: PIP5K1A
  Gene Name: phosphatidylinositol-4-phosphate 5-kinase, type I, alpha
  ENSP ID: ENSP00000392780
MASASSGPSSSVGFSSFDPAVPSCTLSSGFNFLCCGVSGKR

SEQ ID NO: 62770 - protein, 101 aa, Homo sapiens
  Payload ID: 12533
  Gene Symbol: PIP5K1A
  Gene Name: phosphatidylinositol-4-phosphate 5-kinase, type I, alpha
  ENSP ID: ENSP00000401228
MHQIFTELRHCAVPNFVLEANKTQIYFECHSEEASGIKRPMASEVPYASGMPIKKIGHRSVDSSGETTYKKTTSSALKGAIQLGITHTVGSLSTKPERDVL

SEQ ID NO: 62771 - protein, 86 aa, Homo sapiens
  Payload ID: 12533
  Gene Symbol: PIP5K1A
  Gene Name: phosphatidylinositol-4-phosphate 5-kinase, type I, alpha
  ENSP ID: ENSP00000414632
MASEVLEARQDSYISLVPYASGMPIKKIGHRSVDSSGETTYKKTTSSALKGAIQLGITHTVGSLSTKPERDVLMQDFYVVESIFFP

SEQ ID NO: 62772 - protein, 522 aa, Homo sapiens
  Payload ID: 12533
  Gene Symbol: PIP5K1A
  Gene Name: phosphatidylinositol-4-phosphate 5-kinase, type I, alpha
  Uniprot ID: Q99755
  ENSP ID: ENSP00000415648
MASASSGPSSSVGFSSFDPAVPSCTLSSAASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDQFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 62773 - protein, 39 aa, Homo sapiens
  Payload ID: 12533
  Gene Symbol: PIP5K1A
  Gene Name: phosphatidylinositol-4-phosphate 5-kinase, type I, alpha
  ENSP ID: ENSP00000416196
MASASSGPSSSVGFSSFDPAVPSCTLSSGKPGRAWVGSW

SEQ ID NO: 62774 - protein, 540 aa, Homo sapiens
  Payload ID: 12534
  Gene Symbol: PIP5K1B
  Gene Name: phosphatidylinositol-4-phosphate 5-kinase, type I, beta
  Uniprot ID: O14986
  ENSP ID: ENSP00000265382
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQNPRTLLPKFYGLYCMQSGGINIRIVVMNNVLPRSMRMHFTYDLKGSTYKRRASRKEREKSNPTFKDLDFLQDMHEGLYFDTETYNALMKTLQRDCRVLESFKIMDYSLLLGIHFLDHSLKEKEEETPQNVPDAKRTGMQKVLYSTAMESIQGPGKSGDGIITENPDTMGGIPAKSHRGEKLLLFMGIIDILQSYRLMKKLEHSWKALVYDGDTVSVHRPSFYADRFLKFMNSRVFKKIQALKASPSKKRCNSIAALKATSQEIVSSISQEWKDEKRDLLTEGQSFSSLDEEALGSRHRPDLVPSTPSLFEAASLATTISSSSLYVNEHYPHDRPTLYSNSKGLPSSSTFTLEEGTIYLTAEPNTLEVQDDNASVLDVYL

SEQ ID NO: 62775 - protein, 103 aa, Homo sapiens
  Payload ID: 12534
  Gene Symbol: PIP5K1B
  Gene Name: phosphatidylinositol-4-phosphate 5-kinase, type I, beta
  ENSP ID: ENSP00000366498
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPD

SEQ ID NO: 62776 - protein, 162 aa, Homo sapiens
  Payload ID: 12534
  Gene Symbol: PIP5K1B
  Gene Name: phosphatidylinositol-4-phosphate 5-kinase, type I, beta
  ENSP ID: ENSP00000398587
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQN

SEQ ID NO: 62777 - protein, 157 aa, Homo sapiens
  Payload ID: 12534
  Gene Symbol: PIP5K1B
  Gene Name: phosphatidylinositol-4-phosphate 5-kinase, type I, beta
  ENSP ID: ENSP00000411477
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYM

SEQ ID NO: 62778 - protein, 549 aa, Homo sapiens
  Payload ID: 12534
  Gene Symbol: PIP5K1B
  Gene Name: phosphatidylinositol-4-phosphate 5-kinase, type I, beta
  Uniprot ID: O14986
  ENSP ID: ENSP00000435778
MSSAAENGEAAPGKQNEEKTYKKTQVKNQILSRLPKIPCTFIQAWTNTEMITLLACYYFRSVSTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQNPRTLLPKFYGLYCMQSGGINIRIVVMNNVLPRSMRMHFTYDLKGSTYKRRASRKEREKSNPTFKDLDFLQDMHEGLYFDTETYNALMKTLQRDCRVLESFKIMDYSLLLGIHFLDHSLKEKEEETPQNVPDAKRTGMQKVLYSTAMESIQGPGKSGDGIITENPDTMGGIPAKSHRGEKLLLFMGIIDILQSYRLMKKLEHSWKALVYDGDTVSVHRPSFYADRFLKFMNSRVFKKIQALKASPSKKRCNSIAALKATSQEIVSSISQEWKDEKRDLLTEGQSFSSLDEEALGSRHRPDLVPSTPSLFEAASLATTISSSSLYVNEHYPHDRPTLYSNRFKMATSEH

SEQ ID NO: 62779 - protein, 502 aa, Homo sapiens
  Payload ID: 12534
  Gene Symbol: PIP5K1B
  Gene Name: phosphatidylinositol-4-phosphate 5-kinase, type I, beta
  Uniprot ID: O14986
  ENSP ID: ENSP00000438082
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQNPRTLLPKFYGLYCMQSGGINIRIVVMNNVLPRSMRMHFTYDLKGSTYKRRASRKEREKSNPTFKDLDFLQDMHEGLYFDTETYNALMKTLQRDCRVLESFKIMDYSLLLGIHFLDHSLKEKEEETPQNVPDAKRTGMQKVLYSTAMESIQGPGKSGDGIITENPDTMGGIPAKSHRGEKLLLFMGIIDILQSYRLMKKLEHSWKALVYDGDTVSVHRPSFYADRFLKFMNSRVFKKIQALKASPSKKRCNSIAALKATSQEIVSSISQEWKDEKRDLLTEGQSFSSLDEEALGSRHRPDLVPSTPSLFEAASLATTISSSSLYVNEHYPHDRPTLYSNSK

SEQ ID NO: 62780 - protein, 668 aa, Homo sapiens
  Payload ID: 12535
  Gene Symbol: PIP5K1C
  Gene Name: phosphatidylinositol-4-phosphate 5-kinase, type I, gamma
  Uniprot ID: O60331
  ENSP ID: ENSP00000335333
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYFPTDERSWVYSPLHYSAQAPPASDGESDT

SEQ ID NO: 62781 - protein, 700 aa, Homo sapiens
  Payload ID: 12535
  Gene Symbol: PIP5K1C
  Gene Name: phosphatidylinositol-4-phosphate 5-kinase, type I, gamma
  Uniprot ID: O60331
  ENSP ID: ENSP00000444779
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYFWRLWGPHAPTWPWRREGRAACLCPYPPHVVTPFPGTGLCASWSPDGTGGLGAMSCCVSVS

SEQ ID NO: 62782 - protein, 640 aa, Homo sapiens
  Payload ID: 12535
  Gene Symbol: PIP5K1C
  Gene Name: phosphatidylinositol-4-phosphate 5-kinase, type I, gamma
  Uniprot ID: O60331
  ENSP ID: ENSP00000445992
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYF

SEQ ID NO: 62783 - protein, 707 aa, Homo sapiens
  Payload ID: 12535
  Gene Symbol: PIP5K1C
  Gene Name: phosphatidylinositol-4-phosphate 5-kinase, type I, gamma
  Uniprot ID: O60331
  ENSP ID: ENSP00000466363
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYFFTDGRYWIYSPRHRRLRAVTLSASGTVSDRSRPPWGEGAVPLGQQGAAGPRPEAQCLTSVVFQKGFG

SEQ ID NO: 62784 - protein, 191 aa, Homo sapiens
  Payload ID: 12536
  Gene Symbol: PIP5KL1
  Gene Name: phosphatidylinositol-4-phosphate 5-kinase-like 1
  Uniprot ID: Q5T9C9
  ENSP ID: ENSP00000300432
MQSVFYPAGRISERYDIKGCEVSRWVDPAPEGSPLVLVLKDLNFQGKTINLGPQRSWFLRQMELDTTFLRELNVLDYSLLIAFQRLHEDERGPGSSLIFRTARSVQGAQSPEESRAQNRRLLPDAPNALHILDGPEQRYFLGVVDLATVYGLRKRLEHLWKTLRYPGRTFSTVSPARYARRLCQWVEAHTE

SEQ ID NO: 62785 - protein, 394 aa, Homo sapiens
  Payload ID: 12536
  Gene Symbol: PIP5KL1
  Gene Name: phosphatidylinositol-4-phosphate 5-kinase-like 1
  Uniprot ID: Q5T9C9
  ENSP ID: ENSP00000373399
MAAPSPGPREVLAPSPEAGCRAVTSSRRGLLWRLRDKQSRLGLFEISPGHELHGMTCMMQAGLWAATQVSMDHPPTGPPSRDDFSEVLTQVHEGFELGTLAGPAFAWLRRSLGLAEEDYQAALGPGGPYLQFLSTSKSKASFFLSHDQRFFLKTQGRREVQALLAHLPRYVQHLQRHPHSLLARLLGVHSLRVDRGKKTYFIVMQSVFYPAGRISERYDIKGCEVSRWVDPAPEGSPLVLVLKDLNFQGKTINLGPQRSWFLRQMELDTTFLRELNVLDYSLLIAFQRLHEDERGPGSSLIFRTARSVQGAQSPEESRAQNRRLLPDAPNALHILDGPEQRYFLGVVDLATVYGLRKRLEHLWKTLRYPGRTFSTVSPARYARRLCQWVEAHTE

SEQ ID NO: 62786 - protein, 266 aa, Homo sapiens
  Payload ID: 12537
  Gene Symbol: PIP4K2A
  Gene Name: phosphatidylinositol-5-phosphate 4-kinase, type II, alpha
  ENSP ID: ENSP00000326294
MHNILKKYHQYIVECHGITLLPQFLGMYRLNVDGVEIYVIVTRNVFSHRLSVYRKYDLKMANLKATFTFPKPTGSTVAREASDKEKAKELPTLKDNDFINEGQKIYIDDNNKKVFLEKLKKDVEFLAQLKLMDYSLLVGIHDVERAEQEEVECEENDGEEEGESDGTHPVGTPPDSPGNTLNSSPPLAPGEFDPNIDVYGIKCHENSPRKEVYFMAIIDILTHYDAKKKAAHAAKTVKHGAGAEISTVNPEQYSKRFLDFIGHILT

SEQ ID NO: 62787 - protein, 406 aa, Homo sapiens
  Payload ID: 12537
  Gene Symbol: PIP4K2A
  Gene Name: phosphatidylinositol-5-phosphate 4-kinase, type II, alpha
  Uniprot ID: P48426
  ENSP ID: ENSP00000365757
MATPGNLGSSVLASKTKTKKKHFVAQKVKLFRASDPLLSVLMWGVNHSINELSHVQIPVMLMPDDFKAYSKIKVDNHLFNKENMPSHFKFKEYCPMVFRNLRERFGIDDQDFQNSLTRSAPLPNDSQARSGARFHTSYDKRYIIKTITSEDVAEMHNILKKYHQYIVECHGITLLPQFLGMYRLNVDGVEIYVIVTRNVFSHRLSVYRKYDLKGSTVAREASDKEKAKELPTLKDNDFINEGQKIYIDDNNKKVFLEKLKKDVEFLAQLKLMDYSLLVGIHDVERAEQEEVECEENDGEEEGESDGTHPVGTPPDSPGNTLNSSPPLAPGEFDPNIDVYGIKCHENSPRKEVYFMAIIDILTHYDAKKKAAHAAKTVKHGAGAEISTVNPEQYSKRFLDFIGHILT

SEQ ID NO: 62788 - protein, 347 aa, Homo sapiens
  Payload ID: 12537
  Gene Symbol: PIP4K2A
  Gene Name: phosphatidylinositol-5-phosphate 4-kinase, type II, alpha
  Uniprot ID: P48426
  ENSP ID: ENSP00000442098
MLMPDDFKAYSKIKVDNHLFNKENMPSHFKFKEYCPMVFRNLRERFGIDDQDFQNSLTRSAPLPNDSQARSGARFHTSYDKRYIIKTITSEDVAEMHNILKKYHQYIVECHGITLLPQFLGMYRLNVDGVEIYVIVTRNVFSHRLSVYRKYDLKGSTVAREASDKEKAKELPTLKDNDFINEGQKIYIDDNNKKVFLEKLKKDVEFLAQLKLMDYSLLVGIHDVERAEQEEVECEENDGEEEGESDGTHPVGTPPDSPGNTLNSSPPLAPGEFDPNIDVYGIKCHENSPRKEVYFMAIIDILTHYDAKKKAAHAAKTVKHGAGAEISTVNPEQYSKRFLDFIGHILT

SEQ ID NO: 62789 - protein, 142 aa, Homo sapiens
  Payload ID: 12537
  Gene Symbol: PIP4K2A
  Gene Name: phosphatidylinositol-5-phosphate 4-kinase, type II, alpha
  ENSP ID: ENSP00000473858
MHNILKKYHQYIVECHGITLLPQFLGMYRLNVDGVEIYVIVTRNVFSHRLSVYRKYDLKGSTVAREASDKEKAKELPTLKDNDFINEGQKIYIDDNNKKVFLEKLKKDVEFLAQLKLMDYSLLVGIHDVERAEQEEVECEEN

SEQ ID NO: 62790 - protein, 71 aa, Homo sapiens
  Payload ID: 12538
  Gene Symbol: PIP4K2B
  Gene Name: phosphatidylinositol-5-phosphate 4-kinase, type II, beta
  ENSP ID: ENSP00000477549
MLMPDDFKAYSKIKVDNHLFNKENLPSRFKFKEYCPMVFRNLRERFGIDDQDYQNSVTRSAPINSDSQGRC

SEQ ID NO: 62791 - protein, 416 aa, Homo sapiens
  Payload ID: 12538
  Gene Symbol: PIP4K2B
  Gene Name: phosphatidylinositol-5-phosphate 4-kinase, type II, beta
  Uniprot ID: P78356
  ENSP ID: ENSP00000480776
MSSNCTSTTAVAVAPLSASKTKTKKKHFVCQKVKLFRASEPILSVLMWGVNHTINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLTVDGVETYMVVTRNVFSHRLTVHRKYDLKGSTVAREASDKEKAKDLPTFKDNDFLNEGQKLHVGEESKKNFLEKLKRDVEFLAQLKIMDYSLLVGIHDVDRAEQEEMEVEERAEDEECENDGVGGNLLCSYGTPPDSPGNLLSFPRFFGPGEFDPSVDVYAMKSHESSPKKEVYFMAIIDILTPYDTKKKAAHAAKTVKHGAGAEISTVNPEQYSKRFNEFMSNILT

SEQ ID NO: 62792 - protein, 416 aa, Homo sapiens; identical to SEQ ID NO: 62791
  Payload ID: 12538
  Gene Symbol: PIP4K2B
  Gene Name: phosphatidylinositol-5-phosphate 4-kinase, type II, beta
  Uniprot ID: P78356
  ENSP ID: ENSP00000482548

SEQ ID NO: 62793 - protein, 71 aa, Homo sapiens; identical to SEQ ID NO: 62790
  Payload ID: 12538
  Gene Symbol: PIP4K2B
  Gene Name: phosphatidylinositol-5-phosphate 4-kinase, type II, beta
  ENSP ID: ENSP00000487739

SEQ ID NO: 62794 - protein, 421 aa, Homo sapiens
  Payload ID: 12539
  Gene Symbol: PIP4K2C
  Gene Name: phosphatidylinositol-5-phosphate 4-kinase, type II, gamma
  Uniprot ID: Q8TBX8
  ENSP ID: ENSP00000347032
MASSSVPPATVSAATAGPGPGFGFASKTKKKHFVQQKVKVFRAADPLVGVFLWGVAHSINELSQVPPPVMLLPDDFKASSKIKVNNHLFHRENLPSHFKFKEYCPQVFRNLRDRFGIDDQDYLVSLTRNPPSESEGSDGRFLISYDRTLVIKEVSSEDIADMHSNLSNYHQYIVKCHGNTLLPQFLGMYRVSVDNEDSYMLVMRNMFSHRLPVHRKYDLKGSLVSREASDKEKVKELPTLKDMDFLNKNQKVYIGEEEKKIFLEKLKRDVEFLVQLKIMDYSLLLGIHDIIRGSEPEEEAPVREDESEVDGDCSLTGPPALVGSYGTSPEGIGGYIHSHRPLGPGEFESFIDVYAIRSAEGAPQKEVYFMGLIDILTQYDAKKKAAHAAKTVKHGAGAEISTVHPEQYAKRFLDFITNIFA

SEQ ID NO: 62795 - protein, 373 aa, Homo sapiens
  Payload ID: 12539
  Gene Symbol: PIP4K2C
  Gene Name: phosphatidylinositol-5-phosphate 4-kinase, type II, gamma
  Uniprot ID: Q8TBX8
  ENSP ID: ENSP00000412035
MASSSVPPATVSAATAGPGPGFGFASKTKKKHFVQQKVKVFRAADPLVGVFLWGVAHSINELSQVPPPVMLLPDDFKASSKIKVNNHLFHRENLPSHFKFKEYCPQVFRNLRDRFGIDDQDYLYIVKCHGNTLLPQFLGMYRVSVDNEDSYMLVMRNMFSHRLPVHRKYDLKGSLVSREASDKEKVKELPTLKDMDFLNKNQKVYIGEEEKKIFLEKLKRDVEFLVQLKIMDYSLLLGIHDIIRGSEPEEEAPVREDESEVDGDCSLTGPPALVGSYGTSPEGIGGYIHSHRPLGPGEFESFIDVYAIRSAEGAPQKEVYFMGLIDILTQYDAKKKAAHAAKTVKHGAGAEISTVHPEQYAKRFLDFITNIFA

SEQ ID NO: 62796 - protein, 421 aa, Homo sapiens; identical to SEQ ID NO: 62794
  Payload ID: 12539
  Gene Symbol: PIP4K2C
  Gene Name: phosphatidylinositol-5-phosphate 4-kinase, type II, gamma
  Uniprot ID: Q8TBX8
  ENSP ID: ENSP00000439878

SEQ ID NO: 62797 - protein, 403 aa, Homo sapiens
  Payload ID: 12539
  Gene Symbol: PIP4K2C
  Gene Name: phosphatidylinositol-5-phosphate 4-kinase, type II, gamma
  Uniprot ID: Q8TBX8
  ENSP ID: ENSP00000447390
MASSSVPPATVSAATAGPGPGFGFASKTKKKHFVQQKVKVFRAADPLVGVFLWGVAHSINELSQVPPPVMLLPDDFKASSKIKEYCPQVFRNLRDRFGIDDQDYLVSLTRNPPSESEGSDGRFLISYDRTLVIKEVSSEDIADMHSNLSNYHQYIVKCHGNTLLPQFLGMYRVSVDNEDSYMLVMRNMFSHRLPVHRKYDLKGSLVSREASDKEKVKELPTLKDMDFLNKNQKVYIGEEEKKIFLEKLKRDVEFLVQLKIMDYSLLLGIHDIIRGSEPEEEAPVREDESEVDGDCSLTGPPALVGSYGTSPEGIGGYIHSHRPLGPGEFESFIDVYAIRSAEGAPQKEVYFMGLIDILTQYDAKKKAAHAAKTVKHGAGAEISTVHPEQYAKRFLDFITNIFA

SEQ ID NO: 62798 - protein, 171 aa, Homo sapiens
  Payload ID: 12539
  Gene Symbol: PIP4K2C
  Gene Name: phosphatidylinositol-5-phosphate 4-kinase, type II, gamma
  ENSP ID: ENSP00000448042
MASSSVPPATVSAATAGPGPGFGFASKTKKKHFVQQKVKVFRAADPLVGVFLWGVAHSINELSQVPPPVMLLPDDFKASSKIKVNNHLFHRENLPSHFKFKEYCPQVFRNLRDRFGIDDQDYLVSLTRNPPSESEGSDGRFLISYDRTLVIKEVSSEDIADMHSNLSNYHQ

SEQ ID NO: 62799 - protein, 50 aa, Homo sapiens
  Payload ID: 12539
  Gene Symbol: PIP4K2C
  Gene Name: phosphatidylinositol-5-phosphate 4-kinase, type II, gamma
  ENSP ID: ENSP00000449335
MASSSVPPATVSAATAGPGPGFGFASKTKKKHFVQQKVKVFRAADPLVDQ

SEQ ID NO: 62800 - protein, 134 aa, Homo sapiens
  Payload ID: 12539
  Gene Symbol: PIP4K2C
  Gene Name: phosphatidylinositol-5-phosphate 4-kinase, type II, gamma
  ENSP ID: ENSP00000449538
  MOD_RES (1)..(1): Any amino acid
XLLPQFLGMYRVSVDNEDSYMLVMRNMFSHRLPVHRKYDLKVKELPTLKDMDFLNKNQKVYIGEEEKKIFLEKLKRDVEFLVQLKIMDYSLLLGIHDIIRGSEPEEEAPVREDESEVDGDCSLTGPPALVGSYG

SEQ ID NO: 62801 - protein, 160 aa, Homo sapiens
  Payload ID: 12539
  Gene Symbol: PIP4K2C
  Gene Name: phosphatidylinositol-5-phosphate 4-kinase, type II, gamma
  ENSP ID: ENSP00000450197
MASSSVPPATVSAATAGPGPGFGFASKTKKKHFVQQKINELSQVPPPVMLLPDDFKASSKIKVNNHLFHRENLPSHFKFKEYCPQVFRNLRDRFGIDDQDYLVSLTRNPPSESEGSDGRFLISYDRTLVIKEVSSEDIADMHSNLSNYHQYIVKCHGNTL

SEQ ID NO: 62802 - protein, 323 aa, Homo sapiens
  Payload ID: 12540
  Gene Symbol: PLCXD1
  Gene Name: phosphatidylinositol-specific phospholipase C, X domain containing 1
  Uniprot ID: Q9NUJ7
  ENSP ID: ENSP00000371073
MGGQVSASNSFSRLHCRNANEDWMSALCPRLWDVPLHHLSIPGSHDTMTYCLNKKSPISHEESRLLQLLNKALPCITRPVVLKWSVTQALDVTEQLDAGVRYLDLRIAHMLEGSEKNLHFVHMVYTTALVEDTLTEISEWLERHPREVVILACRNFEGLSEDLHEYLVACIKNIFGDMLCPRGEVPTLRQLWSRGQQVIVSYEDESSLRRHHELWPGVPYWWGNRVKTEALIRYLETMKSCGRPGGLFVAGINLTENLQYVLAHPSESLEKMTLPNLPRLSAWVREQCPGPGSRCTNIIAGDFIGADGFVSDVIALNQKLLWC

SEQ ID NO: 62803 - protein, 323 aa, Homo sapiens; identical to SEQ ID NO: 62802
  Payload ID: 12540
  Gene Symbol: PLCXD1
  Gene Name: phosphatidylinositol-specific phospholipase C, X domain containing 1
  Uniprot ID: Q9NUJ7
  ENSP ID: ENSP00000371079

SEQ ID NO: 62804 - protein, 323 aa, Homo sapiens; identical to SEQ ID NO: 62802
  Payload ID: 12540
  Gene Symbol: PLCXD1
  Gene Name: phosphatidylinositol-specific phospholipase C, X domain containing 1
  Uniprot ID: Q9NUJ7
  ENSP ID: ENSP00000381976

SEQ ID NO: 62805 - protein, 174 aa, Homo sapiens
  Payload ID: 12540
  Gene Symbol: PLCXD1
  Gene Name: phosphatidylinositol-specific phospholipase C, X domain containing 1
  ENSP ID: ENSP00000394848
MGGQVSASNSFSRLHCRNANEDWMSALCPRLWDVPLHHLSIPGSHDTMTYCLNKKSPISHEESRLLQLLNKALPCITRPVVLKWSVTQALDVTEQLDAGVRYLDLRIAHMLEGSEKNLHFVHMVYTTALVEDTLTEISEWLERHPREVVILACRNFEGLSEDLHEYLVACIKNI

SEQ ID NO: 62806 - protein, 178 aa, Homo sapiens
  Payload ID: 12540
  Gene Symbol: PLCXD1
  Gene Name: phosphatidylinositol-specific phospholipase C, X domain containing 1
  ENSP ID: ENSP00000399510
MGGQVSASNSFSRLHCRNANEDWMSALCPRLWDVPLHHLSIPGSHDTMTYCLNKKSPISHEESRLLQLLNKALPCITRPVVLKWSVTQALDVTEQLDAGVRYLDLRIAHMLEGSEKNLHFVHMVYTTALVEDTLTEISEWLERHPREVVILACRNFEGLSEDLHEYLVACIKNIFGDM

SEQ ID NO: 62807 - protein, 60 aa, Homo sapiens
  Payload ID: 12540
  Gene Symbol: PLCXD1
  Gene Name: phosphatidylinositol-specific phospholipase C, X domain containing 1
  ENSP ID: ENSP00000400904
MGGQVSASNSFSRLHCRNANEDWMSALCPRLWDVPLHHLSIPGSHDTMTYCLNKKSPISH

SEQ ID NO: 62808 - protein, 174 aa, Homo sapiens; identical to SEQ ID NO: 62805
  Payload ID: 12540
  Gene Symbol: PLCXD1
  Gene Name: phosphatidylinositol-specific phospholipase C, X domain containing 1
  ENSP ID: ENSP00000405307

SEQ ID NO: 62809 - protein, 74 aa, Homo sapiens
  Payload ID: 12540
  Gene Symbol: PLCXD1
  Gene Name: phosphatidylinositol-specific phospholipase C, X domain containing 1
  ENSP ID: ENSP00000408558
MGGQVSASNSFSRLHCRNANEDWMSALCPRLWDVPLHHLSIPGSHDTMTYCLNKKSPISHEESRLLQLLNKALP

SEQ ID NO: 62810 - protein, 88 aa, Homo sapiens
  Payload ID: 12540
  Gene Symbol: PLCXD1
  Gene Name: phosphatidylinositol-specific phospholipase C, X domain containing 1
  ENSP ID: ENSP00000412018
MGGQVSASNSFSRLHCRNANEDWMSALCPRLWDVPLHHLSIPGSHDTMTYCLNKKSPISHEESRLLQLLNKALPCITRPVVLKWSVTQ

SEQ ID NO: 62811 - protein, 124 aa, Homo sapiens
  Payload ID: 12540
  Gene Symbol: PLCXD1
  Gene Name: phosphatidylinositol-specific phospholipase C, X domain containing 1
  ENSP ID: ENSP00000414181
MGGQVSASNSFSRLHCRNANEDWMSALCPRLWDVPLHHLSIPGSHDTMTYCLNKKSPISHEESRLLQLLNKALPCITRPVVLKWSVTQALDVTEQLDAGVRYLDLRIAHMLEGSEKNLHFVHMV

SEQ ID NO: 62812 - protein, 304 aa, Homo sapiens
  Payload ID: 12541
  Gene Symbol: PLCXD2
  Gene Name: phosphatidylinositol-specific phospholipase C, X domain containing 2
  Uniprot ID: Q0VAA5
  ENSP ID: ENSP00000377511
MLAVRKARRKLRMGTICSPNPSGTKTSSEVCNADWMASLPPHLHNLPLSNLAIPGSHDSFSYWVDEKSPVGPDQTQAIKRLARISLVKKLMKKWSVTQNLTFREQLEAGIRYFDLRVSSKPGDADQEIYFIHGLFGIKVWDGLMEIDSFLTQHPQEIIFLDFNHFYAMDETHHKCLVLRIQEAFGNKLCPACSVESLTLRTLWEKNCQVLIFYHCPFYKQYPFLWPGKKIPAPWANTTSVRKLILFLETTLSERASRGSFHVSQAILTPRVKTIARGLVGGLKNTLVHRLALIPVYPLRFSRRS

SEQ ID NO: 62813 - protein, 73 aa, Homo sapiens
  Payload ID: 12541
  Gene Symbol: PLCXD2
  Gene Name: phosphatidylinositol-specific phospholipase C, X domain containing 2
  ENSP ID: ENSP00000417436
MKKWSVTQNLTFREQLEAGIRYFDLRVSSKPGDADQEIYFIHGLFGIKVWDGLMEIDSFLTQHPQEIIFLDFN

SEQ ID NO: 62814 - protein, 305 aa, Homo sapiens
  Payload ID: 12541
  Gene Symbol: PLCXD2
  Gene Name: phosphatidylinositol-specific phospholipase C, X domain containing 2
  Uniprot ID: Q0VAA5
  ENSP ID: ENSP00000420686
MLAVRKARRKLRMGTICSPNPSGTKTSSEVCNADWMASLPPHLHNLPLSNLAIPGSHDSFSYWVDEKSPVGPDQTQAIKRLARISLVKKLMKKWSVTQNLTFREQLEAGIRYFDLRVSSKPGDADQEIYFIHGLFGIKVWDGLMEIDSFLTQHPQEIIFLDFNHFYAMDETHHKCLVLRIQEAFGNKLCPACSVESLTLRTLWEKNCQVLIFYHCPFYKQYPFLWPGKKIPAPWANTTSVRKLILFLETTLSERASRGSFHVSQAILTPRVKTIARGLVGGLKNTLVHSNRWNSHGPSLLSQERS

SEQ ID NO: 62815 - protein, 321 aa, Homo sapiens
  Payload ID: 12542
  Gene Symbol: PLCXD3
  Gene Name: phosphatidylinositol-specific phospholipase C, X domain containing 3
  Uniprot ID: Q63HM9
  ENSP ID: ENSP00000333751
MASSQGKNELKLADWMATLPESMHSIPLTNLAIPGSHDSFSFYIDEASPVGPEQPETVQNFVSVFGTVAKKLMRKWLATQTMNFTGQLGAGIRYFDLRISTKPRDPDNELYFAHGLFSAKVNEGLEEINAFLTDHHKEVVFLDFNHFYGMQKYHHEKLVQMLKDIYGNKMCPAIFAQEVSLKYLWEKDYQVLVFYHSPVALEVPFLWPGQMMPAPWANTTDPEKLIQFLQASITERRKKGSFFISQVVLTPKASTVVKGVASGLRETITERALPAMMQWVRTQKPGESGINIVTADFVELGDFISTVIKLNYVFDEGEANT

SEQ ID NO: 62816 - protein, 321 aa, Homo sapiens; identical to SEQ ID NO: 62815
  Payload ID: 12542
  Gene Symbol: PLCXD3
  Gene Name: phosphatidylinositol-specific phospholipase C, X domain containing 3
  Uniprot ID: Q63HM9
  ENSP ID: ENSP00000367032

SEQ ID NO: 62817 - protein, 375 aa, Homo sapiens
  Payload ID: 12543
  Gene Symbol: PISD
  Gene Name: phosphatidylserine decarboxylase
  Uniprot ID: Q9UG56
  ENSP ID: ENSP00000266095
MMCQSEARQGPELRAAKWLHFPQLALRRRLGQLSCMSRPALKLRSWPLTVLYYLLPFGALRPLSRVGWRPVSRVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 62818 - protein, 375 aa, Homo sapiens; identical to SEQ ID NO: 62817
  Payload ID: 12543
  Gene Symbol: PISD
  Gene Name: phosphatidylserine decarboxylase
  Uniprot ID: Q9UG56
  ENSP ID: ENSP00000371586

SEQ ID NO: 62819 - protein, 262 aa, Homo sapiens
  Payload ID: 12543
  Gene Symbol: PISD
  Gene Name: phosphatidylserine decarboxylase
  ENSP ID: ENSP00000380637
MMCQSEARQGPELRAAKWLHFPQLALRRRLGQLSCMSRPALKLRSWPLTVLYYLLPFGALRPLSRVGWRPVSRVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGPAHKQPKAQQGLLQ

SEQ ID NO: 62820 - protein, 409 aa, Homo sapiens
  Payload ID: 12543
  Gene Symbol: PISD
  Gene Name: phosphatidylserine decarboxylase
  Uniprot ID: Q9UG56
  ENSP ID: ENSP00000391739
MATSVGHRCLGLLHGVAPWRSSLHPCEITALSQSLQPLRKLPFRAFRTDARKIHTAPARTMFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 62821 - protein, 73 aa, Homo sapiens
  Payload ID: 12543
  Gene Symbol: PISD
  Gene Name: phosphatidylserine decarboxylase
  ENSP ID: ENSP00000396002
MMCQSEARQGPELRAAKWLHFPQLALRRRLGQLSCMSRPALKLRSWPLTVLYYLLPFGALRPLSRVGWRPVSR

SEQ ID NO: 62822 - protein, 56 aa, Homo sapiens
  Payload ID: 12543
  Gene Symbol: PISD
  Gene Name: phosphatidylserine decarboxylase
  ENSP ID: ENSP00000396500
MATSVGHRCLGLLHGVAPWRSRCQKNPHCPCPNHVPAASPAHSVGDRRRVCRVPAV

SEQ ID NO: 62823 - protein, 81 aa, Homo sapiens
  Payload ID: 12543
  Gene Symbol: PISD
  Gene Name: phosphatidylserine decarboxylase
  ENSP ID: ENSP00000399818
MMCQSEARQGPELRAAKWLHFPQLALRRRLGQLSCMSRPALKLRSWPLTVLYYLLPFGALRPLSRVGWRPVSRVALYKSVP

SEQ ID NO: 62824 - protein, 73 aa, Homo sapiens; identical to SEQ ID NO: 62821
  Payload ID: 12543
  Gene Symbol: PISD
  Gene Name: phosphatidylserine decarboxylase
  ENSP ID: ENSP00000401606

SEQ ID NO: 62825 - protein, 228 aa, Homo sapiens
  Payload ID: 12543
  Gene Symbol: PISD
  Gene Name: phosphatidylserine decarboxylase
  ENSP ID: ENSP00000412169
MMCQSEARQGPELRAAKWLHFPQLALRRRLGQLSCMSRPALKLRSWPLTVLYYLLPFGALRPLSRVGWRPVSRVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGD

SEQ ID NO: 62826 - protein, 362 aa, Homo sapiens
  Payload ID: 12543
  Gene Symbol: PISD
  Gene Name: phosphatidylserine decarboxylase
  ENSP ID: ENSP00000414395
  MOD_RES (1)..(1): Any amino acid
XGLLHGVAPWRSSLHPCEITALSQSLQPLRKLPFRAFRTDARKIHTAPARTMFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 62827 - protein, 108 aa, Homo sapiens
  Payload ID: 12544
  Gene Symbol: PTDSS1
  Gene Name: phosphatidylserine synthase 1
  ENSP ID: ENSP00000337331
MASCVGSRTLSKDDVNYKMHFRMINEQQVEDITIDFFYRPHTITLLSFTIVSLMYFAFTRDDSVPEDNIWRGILSVIFFFLIISVLAFPNGVCCELPCDHLGEDYQPL

SEQ ID NO: 62828 - protein, 473 aa, Homo sapiens
  Payload ID: 12544
  Gene Symbol: PTDSS1
  Gene Name: phosphatidylserine synthase 1
  Uniprot ID: P48651
  ENSP ID: ENSP00000430548
MASCVGSRTLSKDDVNYKMHFRMINEQQVEDITIDFFYRPHTITLLSFTIVSLMYFAFTRDDSVPEDNIWRGILSVIFFFLIISVLAFPNGPFTRPHPALWRMVFGLSVLYFLFLVFLLFLNFEQVKSLMYWLDPNLRYATREADVMEYAVNCHVITWERIISHFDIFAFGHFWGWAMKALLIRSYGLCWTISITWELTELFFMHLLPNFAECWWDQVILDILLCNGGGIWLGMVVCRFLEMRTYHWASFKDIHTTTGKIKRAVLQFTPASWTYVRWFDPKSSFQRVAGVYLFMIIWQLTELNTFFLKHIFVFQASHPLSWGRILFIGGITAPTVRQYYAYLTDTQCKRVGTQCWVFGVIGFLEAIVCIKFGQDLFSKTQILYVVLWLLCVAFTTFLCLYGMIWYAEHYGHREKTYSECEDGTYSPEISWHHRKGTKGSEDSPPKHAGNNESHSSRRRNRHSKSKVTNGVGKK

SEQ ID NO: 62829 - protein, 301 aa, Homo sapiens
  Payload ID: 12544
  Gene Symbol: PTDSS1
  Gene Name: phosphatidylserine synthase 1
  Uniprot ID: P48651
  ENSP ID: ENSP00000430928
MHLLPNFAECWWDQVILDILLCNGGGIWLGMVVCRFLEMRTYHWASFKDIHTTTGKIKRAVLQFTPASWTYVRWFDPKSSFQRVAGVYLFMIIWQLTELNTFFLKHIFVFQASHPLSWGRILFIGGITAPTVRQYYAYLTDTQCKRVGTQCWVFGVIGFLEAIVCIKFGQDLFSKTQILYVVLWLLCVAFTTFLCLYGMIWYAEHYGHREKTYSECEDGTYSPEISWHHRKGTKGSEDSPPKHAGEGTWGSLFEIVSLVSHRPGRVRQIIAWGAFANVGSLLTSALDMRSPVAARCVEGKR

SEQ ID NO: 62830 - protein, 487 aa, Homo sapiens
  Payload ID: 12545
  Gene Symbol: PTDSS2
  Gene Name: phosphatidylserine synthase 2
  Uniprot ID: Q9BVG9
  ENSP ID: ENSP00000308258
MRRGERRDAGGPRPESPVPAGRASLEEPPDGPSAGQATGPGEGRRSTESEVYDDGTNTFFWRAHTLTVLFILTCTLGYVTLLEETPQDTAYNTKRGIVASILVFLCFGVTQAKDGPFSRPHPAYWRFWLCVSVVYELFLIFILFQTVQDGRQFLKYVDPKLGVPLPERDYGGNCLIYDPDNETDPFHNIWDKLDGFVPAHFLGWYLKTLMIRDWWMCMIISVMFEFLEYSLEHQLPNFSECWWDHWIMDVLVCNGLGIYCGMKTLEWLSLKTYKWQGLWNIPTYKGKMKRIAFQFTPYSWVRFEWKPASSLRRWLAVCGIILVFLLAELNTFYLKFVLWMPPEHYLVLLRLVFFVNVGGVAMREIYDFMDDPKPHKKLGPQAWLVAAITATELLIVVKYDPHTLTLSLPFYISQCWTLGSVLALTWTVWRFFLRDITLRYKETRWQKWQNKDDQGSTVGNGDQHPLGLDEDLLGPGVAEGEGAPTPN

SEQ ID NO: 62831 - protein, 60 aa, Homo sapiens
  Payload ID: 12545
  Gene Symbol: PTDSS2
  Gene Name: phosphatidylserine synthase 2
  ENSP ID: ENSP00000432100
MRRGERRDAGGPRPESPVPAGRASLEEPPDGPSAGQATGPGEGRRSTESEVYDDGTNTFF

SEQ ID NO: 62832 - protein, 81 aa, Homo sapiens
  Payload ID: 12545
  Gene Symbol: PTDSS2
  Gene Name: phosphatidylserine synthase 2
  ENSP ID: ENSP00000435168
MRRGERRDAGGPRPESPVPAGRASLEEPPDGPSAGQATGPGEGRRSTESEVYDDGTNTFFCCDPGLALCRCSSVRRIKPST

SEQ ID NO: 62833 - protein, 393 aa, Homo sapiens
  Payload ID: 12545
  Gene Symbol: PTDSS2
  Gene Name: phosphatidylserine synthase 2
  ENSP ID: ENSP00000488064
  MOD_RES (1)..(1): Any amino acid
XGIVASILVFLCFGVTQAKDGPFSRPHPAYWRFWLCVSVVYELFLIFILFQTVQDGRQFLKYVDPKLGVPLPERDYGGNCLIYDPDNETDPFHNIWDKLDGFVPAHFLGWYLKTLMIRDWWMCMIISVMFEFLEYSLEHQLPNFSECWWDHWIMDVLVCNGLGIYCGMKTLEWLSLKTYKWQGLWNIPTYKGKMKRIAFQFTPYSWVRFEWKPASSLRRWLAVCGIILVFLLAELNTFYLKFVLWMPPEHYLVLLRLVFFVNVGGVAMREIYDFMDDPKPHKKLGPQAWLVAAITATELLIVVKYDPHTLTLSLPFYISQCWTLGSVLALTWTVWRFFLRDITLRYKETRWQKWQNKDDQGSTVGNGDQHPLGLDEDLLGPGVAEGEGAPTPN

SEQ ID NO: 62834 - protein, 779 aa, Homo sapiens
  Payload ID: 12546
  Gene Symbol: PDE10A
  Gene Name: phosphodiesterase 10A
  Uniprot ID: Q9Y233
  ENSP ID: ENSP00000355847
MRIEERKSQHLTGLTDEKVKAYLSLHPQVLDEFVSESVSAETVEKWLKRKNNKSEDESAPKEVSRYQDTNMQGVVYELNSYIEQRLDTGGDNQLLLYELSSIIKIATKADGFALYFLGECNNSLCIFTPPGIKEGKPRLIPAGPITQGTTVSAYVAKSRKTLLVEDILGDERFPRGTGLESGTRIQSVLCLPIVTAIGDLIGILELYRHWGKEAFCLSHQEVATANLAWASVAIHQVQVCRGLAKQTELNDFLLDVSKTYFDNIVAIDSLLEHIMIYAKNLVNADRCALFQVDHKNKELYSDLFDIGEEKEGKPVFKKTKEIRFSIEKGIAGQVARTGEVLNIPDAYADPRFNREVDLYTGYTTRNILCMPIVSRGSVIGVVQMVNKISGSAFSKTDENNFKMFAVFCALALHCANMYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEETATWISSPSVAQKAAASED

SEQ ID NO: 62835 - protein, 789 aa, Homo sapiens
  Payload ID: 12546
  Gene Symbol: PDE10A
  Gene Name: phosphodiesterase 10A
  Uniprot ID: Q9Y233
  ENSP ID: ENSP00000438284
MEDGPSNNASCFRRLTECFLSPSLTDEKVKAYLSLHPQVLDEFVSESVSAETVEKWLKRKNNKSEDESAPKEVSRYQDTNMQGVVYELNSYIEQRLDTGGDNQLLLYELSSIIKIATKADGFALYFLGECNNSLCIFTPPGIKEGKPRLIPAGPITQGTTVSAYVAKSRKTLLVEDILGDERFPRGTGLESGTRIQSVLCLPIVTAIGDLIGILELYRHWGKEAFCLSHQEVATANLAWASVAIHQVQVCRGLAKQTELNDFLLDVSKTYFDNIVAIDSLLEHIMIYAKNLVNADRCALFQVDHKNKELYSDLFDIGEEKEGKPVFKKTKEIRFSIEKGIAGQVARTGEVLNIPDAYADPRFNREVDLYTGYTTRNILCMPIVSRGSVIGVVQMVNKISGSAFSKTDENNFKMFAVFCALALHCANMYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEETATWISSPSVAQKAAASED

SEQ ID NO: 62836 - protein, 183 aa, Homo sapiens
  Payload ID: 12546
  Gene Symbol: PDE10A
  Gene Name: phosphodiesterase 10A
  ENSP ID: ENSP00000478556
MEGEQGEDGKTAAGPGRSTSGCRRSRPWAPARLRRQSGRVRLPAAQSAAPEPPSTACAPEPLSAPRSGAAFPRRLLWADALPGLLFRFPAPNCGSFPGFGRPGSPGHPRLSPSLRPKLLRAHRPLRHLWGAAPGLASVFAPGSAAPCNPASRARASPRRPRGQRPLVHPCGLRLASRCLRLIG

SEQ ID NO: 62837 - protein, 933 aa, Homo sapiens
  Payload ID: 12547
  Gene Symbol: PDE11A
  Gene Name: phosphodiesterase 11A
  Uniprot ID: Q9HCR9
  ENSP ID: ENSP00000286063
MAASRLDFGEVETFLDRHPELFEDYLMRKGKQEMVEKWLQRHSQGQGALGPRPSLAGTSSLAHSTCRGGSSVGGGTGPNGSAHSQPLPGGGDCGGVPLSPSWAGGSRGDGNLQRRASQKELRKSFARSKAIHVNRTYDEQVTSRAQEPLSSVRRRALLRKASSLPPTTAHILSALLESRVNLPRYPPTAIDYKCHLKKHNERQFFLELVKDISNDLDLTSLSYKILIFVCLMVDADRCSLFLVEGAAAGKKTLVSKFFDVHAGTPLLPCSSTENSNEVQVPWGKGIIGYVGEHGETVNIPDAYQDRRFNDEIDKLTGYKTKSLLCMPIRSSDGEIIGVAQAINKIPEGAPFTEDDEKVMQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 62838 - protein, 683 aa, Homo sapiens
  Payload ID: 12547
  Gene Symbol: PDE11A
  Gene Name: phosphodiesterase 11A
  Uniprot ID: Q9HCR9
  ENSP ID: ENSP00000351232
MLKQARRPLFRNVLSATQWKKVKITRLVQISGASLAEKQEKHQDFLIQRQTKTKDRRFNDEIDKLTGYKTKSLLCMPIRSSDGEIIGVAQAINKIPEGAPFTEDDEKVMQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 62839 - protein, 489 aa, Homo sapiens
  Payload ID: 12547
  Gene Symbol: PDE11A
  Gene Name: phosphodiesterase 11A
  Uniprot ID: Q9HCR9
  ENSP ID: ENSP00000374333
MSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 62840 - protein, 575 aa, Homo sapiens
  Payload ID: 12547
  Gene Symbol: PDE11A
  Gene Name: phosphodiesterase 11A
  Uniprot ID: Q9HCR9
  ENSP ID: ENSP00000386539
MQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 62841 - protein, 36 aa, Homo sapiens
  Payload ID: 12547
  Gene Symbol: PDE11A
  Gene Name: phosphodiesterase 11A
  ENSP ID: ENSP00000389777
MQMYLPFCGIAISNAQLFAASRKEYERSRSYVRDVY

SEQ ID NO: 62842 - protein, 136 aa, Homo sapiens
  Payload ID: 12547
  Gene Symbol: PDE11A
  Gene Name: phosphodiesterase 11A
  ENSP ID: ENSP00000406922
  MOD_RES (1)..(1): Any amino acid
XVLPLVEERKISMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 62843 - protein, 437 aa, Homo sapiens
  Payload ID: 12547
  Gene Symbol: PDE11A
  Gene Name: phosphodiesterase 11A
  ENSP ID: ENSP00000416884
  MOD_RES (1)..(1): Any amino acid
XLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQ

SEQ ID NO: 62844 - protein, 609 aa, Homo sapiens
  Payload ID: 12548
  Gene Symbol: PDE12
  Gene Name: phosphodiesterase 12
  Uniprot ID: Q6L8Q7
  ENSP ID: ENSP00000309142
MWRLPGARAALRVIRTAVEKLSRAEAGSQTAAGAMERAVVRCVPSEPKLSLSFALADGSHKNMQRDQSEPLGRVLSRIATNALKGHAKAAAAKKSRKSRPNASGGAACSGPGPEPAVFCEPVVKLYYREEAVAEDVLNVDAWQDGAVLQIGDVKYKVERNPPAFTELQLPRYIMAGFPVCPKLSLEFGDPASSLFRWYKEAKPGAAEPEVGVPSSLSPSSPSSSWTETDVEERVYTPSNADIGLRLKLHCTPGDGQRFGHSRELESVCVVEAGPGTCTFDHRHLYTKKVTEDALIRTVSYNILADTYAQTEFSRTVLYPYCAPYALELDYRQNLIQKELTGYNADVICLQEVDRAVFSDSLVPALEAFGLEGVFRIKQHEGLATFYRKSKFSLLSQHDISFYEALESDPLHKELLEKLVLYPSAQEKVLQRSSVLQVSVLQSTKDSSKRICVANTHLYWHPKGGYIRLIQMAVALAHIRHVSCDLYPGIPVIFCGDFNSTPSTGMYHFVINGSIPEDHEDWASNGEEERCNMSLTHFFKLKSACGEPAYTNYVGGFHGCLDYIFIDLNALEVEQVIPLPSHEEVTTHQALPSVSHPSDHIALVCDLKWK

SEQ ID NO: 62845 - protein, 472 aa, Homo sapiens
  Payload ID: 12548
  Gene Symbol: PDE12
  Gene Name: phosphodiesterase 12
  ENSP ID: ENSP00000420626
MWRLPGARAALRVIRTAVEKLSRAEAGSQTAAGAMERAVVRCVPSEPKLSLSFALADGSHKNMQRDQSEPLGRVLSRIATNALKGHAKAAAAKKSRKSRPNASGGAACSGPGPEPAVFCEPVVKLYYREEAVAEDVLNVDAWQDGAVLQIGDVKYKVERNPPAFTELQLPRYIMAGFPVCPKLSLEFGDPASSLFRWYKEAKPGAAEPEVGVPSSLSPSSPSSSWTETDVEERVYTPSNADIGLRLKLHCTPGDGQRFGHSRELESVCVVEAGPGTCTFDHRHLYTKKVTEDALIRTVSYNILADTYAQTEFSRTVLYPYCAPYALELDYRQNLIQKELTGYNADVICLQEVDRAVFSDSLVPALEAFGLEGVFRIKQHEGLATFYRKSKFSLLSQHDISFYEALESDPLHKELLEKLVLYPSAQEKVLQRSSVLQVSVLQSTKDSSKRICVANTHLYWHPKGRFYLVSQVT

SEQ ID NO: 62846 - protein, 519 aa, Homo sapiens
  Payload ID: 12549
  Gene Symbol: PDE1A
  Gene Name: phosphodiesterase 1A, calmodulin-dependent
  Uniprot ID: P54750
  ENSP ID: ENSP00000309269
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 62847 - protein, 501 aa, Homo sapiens
  Payload ID: 12549
  Gene Symbol: PDE1A
  Gene Name: phosphodiesterase 1A, calmodulin-dependent
  Uniprot ID: P54750
  ENSP ID: ENSP00000350858
MGKKINKLFCFNFLVQCFRGKSKPSKCQIRKKVKNHIERLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 62848 - protein, 529 aa, Homo sapiens
  Payload ID: 12549
  Gene Symbol: PDE1A
  Gene Name: phosphodiesterase 1A, calmodulin-dependent
  Uniprot ID: P54750
  ENSP ID: ENSP00000386767
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQGESDLHKNSEDLVNAEEKHDETHS

SEQ ID NO: 62849 - protein, 535 aa, Homo sapiens
  Payload ID: 12549
  Gene Symbol: PDE1A
  Gene Name: phosphodiesterase 1A, calmodulin-dependent
  Uniprot ID: P54750
  ENSP ID: ENSP00000387037
MGSSATEIEELENTTFKYLTGEQTEKMWQRLKGILRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 62850 - protein, 545 aa, Homo sapiens
  Payload ID: 12549
  Gene Symbol: PDE1A
  Gene Name: phosphodiesterase 1A, calmodulin-dependent
  Uniprot ID: P54750
  ENSP ID: ENSP00000410309
MGSSATEIEELENTTFKYLTGEQTEKMWQRLKGILRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQGESDLHKNSEDLVNAEEKHDETHS

SEQ ID NO: 62851 - protein, 536 aa, Homo sapiens
  Payload ID: 12550
  Gene Symbol: PDE1B
  Gene Name: phosphodiesterase 1B, calmodulin-dependent
  Uniprot ID: Q01064
  ENSP ID: ENSP00000243052
MELSPRSPPEMLEESDCPSPLELKSAPSKKMWIKLRSLLRYMVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 62852 - protein, 495 aa, Homo sapiens
  Payload ID: 12550
  Gene Symbol: PDE1B
  Gene Name: phosphodiesterase 1B, calmodulin-dependent
  ENSP ID: ENSP00000442559
MVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 62853 - protein, 191 aa, Homo sapiens
  Payload ID: 12550
  Gene Symbol: PDE1B
  Gene Name: phosphodiesterase 1B, calmodulin-dependent
  ENSP ID: ENSP00000447354
MELSPRSPPEMLEESDCPSPLELKSAPSKKMWIKLRSLLRYMVKQLENGEINIEELKKNLEYTASLLEAVYIDETRVSRLWKHLLSFLCDSPSGVSGKSWTRRTSCRSCGQMPCLRRCGTGWPPPSPSRPGPKAAEQRRSPSSEALCTLCRLGSSWNGCSGEHTPLWAPLTLLRFSTVSRTWISGALMSFP

SEQ ID NO: 62854 - protein, 516 aa, Homo sapiens
  Payload ID: 12550
  Gene Symbol: PDE1B
  Gene Name: phosphodiesterase 1B, calmodulin-dependent
  Uniprot ID: Q01064
  ENSP ID: ENSP00000448519
MANPVPVQRSHLQGPILRLRYMVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 62855 - protein, 50 aa, Homo sapiens
  Payload ID: 12550
  Gene Symbol: PDE1B
  Gene Name: phosphodiesterase 1B, calmodulin-dependent
  ENSP ID: ENSP00000478185
MELSPRSPPEMLEESDCPSPLELKSAPSKKMWIKLRSLPHGVIFYGSYQF

SEQ ID NO: 62856 - protein, 709 aa, Homo sapiens
  Payload ID: 12551
  Gene Symbol: PDE1C
  Gene Name: phosphodiesterase 1C, calmodulin-dependent 70kDa
  Uniprot ID: Q14123
  ENSP ID: ENSP00000318105
MESPTKEIEEFESNSLKYLQPEQIEKIWLRLRGLRKYKKTSQRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDGTKQRSHGSPAPSTSSTCRLTLPVIKPPLRHFKRPAYASSSYAPSVSKKTDEHPARYKMLDQRIKMKKIQNISHNWNRK

SEQ ID NO: 62857 - protein, 634 aa, Homo sapiens
  Payload ID: 12551
  Gene Symbol: PDE1C
  Gene Name: phosphodiesterase 1C, calmodulin-dependent 70kDa
  Uniprot ID: Q14123
  ENSP ID: ENSP00000379485
MESPTKEIEEFESNSLKYLQPEQIEKIWLRLRGLRKYKKTSQRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDDSQE

SEQ ID NO: 62858 - protein, 634 aa, Homo sapiens; identical to SEQ ID NO: 62857
  Payload ID: 12551
  Gene Symbol: PDE1C
  Gene Name: phosphodiesterase 1C, calmodulin-dependent 70kDa
  Uniprot ID: Q14123
  ENSP ID: ENSP00000379487

SEQ ID NO: 62859 - protein, 46 aa, Homo sapiens
  Payload ID: 12551
  Gene Symbol: PDE1C
  Gene Name: phosphodiesterase 1C, calmodulin-dependent 70kDa
  ENSP ID: ENSP00000379492
MESPTKEIEEFESNSLKYLQPEQIEKIWLRLRGLRKYKKTSQRLRS

SEQ ID NO: 62860 - protein, 709 aa, Homo sapiens; identical to SEQ ID NO: 62856
  Payload ID: 12551
  Gene Symbol: PDE1C
  Gene Name: phosphodiesterase 1C, calmodulin-dependent 70kDa
  Uniprot ID: Q14123
  ENSP ID: ENSP00000379494

SEQ ID NO: 62861 - protein, 769 aa, Homo sapiens
  Payload ID: 12551
  Gene Symbol: PDE1C
  Gene Name: phosphodiesterase 1C, calmodulin-dependent 70kDa
  ENSP ID: ENSP00000379496
MTDAGNRKEGFKKCRSATFSIDGYSFTIVANEAGDKNARPLARFSRSKSQNCLWNSLIDGLTGNVKEKPRPTIVHDPRPPEEILADELPQLDSPEVLVKTSFRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDGTKQRSHGSPAPSTSSTCRLTLPVIKPPLRHFKRPAYASSSYAPSVSKKTDEHPARYKMLDQRIKMKKIQNISHNWNRK

SEQ ID NO: 62862 - protein, 941 aa, Homo sapiens
  Payload ID: 12552
  Gene Symbol: PDE2A
  Gene Name: phosphodiesterase 2A, cGMP-stimulated
  Uniprot ID: O00408
  ENSP ID: ENSP00000334910
MGQACGHSILCRSQQYPAARPAEPRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 62863 - protein, 685 aa, Homo sapiens
  Payload ID: 12552
  Gene Symbol: PDE2A
  Gene Name: phosphodiesterase 2A, cGMP-stimulated
  Uniprot ID: O00408
  ENSP ID: ENSP00000365633
MVLVLHHILIAVVQFLRRGQQVFLKPDEPPPPPQPCADSLQDALLSLGSVIDISGLQRAVKEALSAVLPRVETVYTYLLDGESQLVCEDPPHELPQEGKVRFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 62864 - protein, 197 aa, Homo sapiens
  Payload ID: 12552
  Gene Symbol: PDE2A
  Gene Name: phosphodiesterase 2A, cGMP-stimulated
  ENSP ID: ENSP00000388997
MLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKT

SEQ ID NO: 62865 - protein, 327 aa, Homo sapiens
  Payload ID: 12552
  Gene Symbol: PDE2A
  Gene Name: phosphodiesterase 2A, cGMP-stimulated
  ENSP ID: ENSP00000392457
FPTASSVPEHKGVGFHAWDVRNLRKLRGQVPAGSLPPTDPSLHRWFLAPLPSPEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEG

SEQ ID NO: 62866 - protein, 826 aa, Homo sapiens
  Payload ID: 12552
  Gene Symbol: PDE2A
  Gene Name: phosphodiesterase 2A, cGMP-stimulated
  ENSP ID: ENSP00000410310
MGQACGHSILCRSQQYPAARPAEPRGQQVFLKPDEPPPPPQPCADSLQVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 62867 - protein, 920 aa, Homo sapiens
  Payload ID: 12552
  Gene Symbol: PDE2A
  Gene Name: phosphodiesterase 2A, cGMP-stimulated
  Uniprot ID: O00408
  ENSP ID: ENSP00000411657
MRRQPAASLDPLAKEPGPPGSRDDRLEDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 62868 - protein, 92 aa, Homo sapiens
  Payload ID: 12552
  Gene Symbol: PDE2A
  Gene Name: phosphodiesterase 2A, cGMP-stimulated
  ENSP ID: ENSP00000438008
MVLVLHHILIAVVQFLRRGQQVFLKPDEPPPPPQPCADSLQETVYTYLLDGRLSSPRSGWAAMGWASQTCQGSPWPGWWLHWLLIPKCWSCR

SEQ ID NO: 62869 - protein, 39 aa, Homo sapiens
  Payload ID: 12552
  Gene Symbol: PDE2A
  Gene Name: phosphodiesterase 2A, cGMP-stimulated
  ENSP ID: ENSP00000438295
MGQACGHSILCRSQQYPAARPAEPSLQLPEHCFHTCDLI

SEQ ID NO: 62870 - protein, 106 aa, Homo sapiens
  Payload ID: 12552
  Gene Symbol: PDE2A
  Gene Name: phosphodiesterase 2A, cGMP-stimulated
  ENSP ID: ENSP00000438559
MVLVLHHILIAVVQFLRRGQQVFLKPDEPPPPPQPCADSLQDALLSLGSVIDISGLQRAVKEALSAVLPRVETVYTYLLDGESQLVCEDPPHELPQEGKVRCTVAS

SEQ ID NO: 62871 - protein, 65 aa, Homo sapiens
  Payload ID: 12552
  Gene Symbol: PDE2A
  Gene Name: phosphodiesterase 2A, cGMP-stimulated
  ENSP ID: ENSP00000438868
MVLVLHHILIAVVQFLRRGQQVFLKPDEPPPPPQPCADSLQPAWTPLQRSQDPQGVETTDWRTPC

SEQ ID NO: 62872 - protein, 336 aa, Homo sapiens
  Payload ID: 12552
  Gene Symbol: PDE2A
  Gene Name: phosphodiesterase 2A, cGMP-stimulated
  ENSP ID: ENSP00000439077
PGLDRSRGRGRAELGGEVGGLGDPGSRRRARRGAERRLRDPDTEVRRGPLSDRRLALAGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQ

SEQ ID NO: 62873 - protein, 38 aa, Homo sapiens
  Payload ID: 12552
  Gene Symbol: PDE2A
  Gene Name: phosphodiesterase 2A, cGMP-stimulated
  ENSP ID: ENSP00000439302
MGQACGHSILCRSQQYPAARPAEPQPGPPCKGARTPRE

SEQ ID NO: 62874 - protein, 144 aa, Homo sapiens
  Payload ID: 12552
  Gene Symbol: PDE2A
  Gene Name: phosphodiesterase 2A, cGMP-stimulated
  ENSP ID: ENSP00000439683
MRRQPAASLDPLAKEPGPPGSRDDRLEDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVH

SEQ ID NO: 62875 - protein, 178 aa, Homo sapiens
  Payload ID: 12552
  Gene Symbol: PDE2A
  Gene Name: phosphodiesterase 2A, cGMP-stimulated
  ENSP ID: ENSP00000440834
MMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFD

SEQ ID NO: 62876 - protein, 172 aa, Homo sapiens
  Payload ID: 12552
  Gene Symbol: PDE2A
  Gene Name: phosphodiesterase 2A, cGMP-stimulated
  ENSP ID: ENSP00000441322
  MOD_RES (1)..(1): Any amino acid
XSAVTPSPCLSLSQLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDV

SEQ ID NO: 62877 - protein, 934 aa, Homo sapiens
  Payload ID: 12552
  Gene Symbol: PDE2A
  Gene Name: phosphodiesterase 2A, cGMP-stimulated
  Uniprot ID: O00408
  ENSP ID: ENSP00000442256
MVLVLHHILIAVVQFLRRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 62878 - protein, 65 aa, Homo sapiens; identical to SEQ ID NO: 62871
  Payload ID: 12552
  Gene Symbol: PDE2A
  Gene Name: phosphodiesterase 2A, cGMP-stimulated
  ENSP ID: ENSP00000442797

SEQ ID NO: 62879 - protein, 86 aa, Homo sapiens
  Payload ID: 12552
  Gene Symbol: PDE2A
  Gene Name: phosphodiesterase 2A, cGMP-stimulated
  ENSP ID: ENSP00000443232
MRRQPAASLDPLAKEPGPPGSRDDRLEDALLSLGSVIDISGLQRAVKEALSAVLPRVETVYTYLLDGESQLVCEDPPHELPQEGKV

SEQ ID NO: 62880 - protein, 75 aa, Homo sapiens
  Payload ID: 12552
  Gene Symbol: PDE2A
  Gene Name: phosphodiesterase 2A, cGMP-stimulated
  ENSP ID: ENSP00000443737
  MOD_RES (1)..(1): Any amino acid
XLWLVASGGRHSAFPVSHPKGVGLACLPSTVASTGGCHWETGRAWEFRELRPAWTPLQRSQDPQGVETTDWRTPC

SEQ ID NO: 62881 - protein, 65 aa, Homo sapiens; identical to SEQ ID NO: 62871
  Payload ID: 12552
  Gene Symbol: PDE2A
  Gene Name: phosphodiesterase 2A, cGMP-stimulated
  ENSP ID: ENSP00000445443

SEQ ID NO: 62882 - protein, 92 aa, Homo sapiens
  Payload ID: 12552
  Gene Symbol: PDE2A
  Gene Name: phosphodiesterase 2A, cGMP-stimulated
  ENSP ID: ENSP00000445750
MSYILKMPGTCLPGEGTTYELPPSSLHPSSAPVTSGGTCPALLTEAGWEAPIMAFTEAASAVGPSWTHSGASRSSSSRTSRRRRRSHAPTAC

SEQ ID NO: 62883 - protein, 932 aa, Homo sapiens
  Payload ID: 12552
  Gene Symbol: PDE2A
  Gene Name: phosphodiesterase 2A, cGMP-stimulated
  Uniprot ID: O00408
  ENSP ID: ENSP00000446399
MKKQRIQEGKSLAHRRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 62884 - protein, 1141 aa, Homo sapiens
  Payload ID: 12553
  Gene Symbol: PDE3A
  Gene Name: phosphodiesterase 3A, cGMP-inhibited
  Uniprot ID: Q14432
  ENSP ID: ENSP00000351957
MAVPGDAARVRDKPVHSGVSQAPTAGRDCHHRADPASPRDSGCRGCWGDLVLQPLRSSRKLSSALCAGSLSFLLALLVRLVRGEVGCDLEQCKEAAAAEEEEAAPGAEGGVFPGPRGGAPGGGARLSPWLQPSALLFSLLCAFFWMGLYLLRAGVRLPLAVALLAACCGGEALVQIGLGVGEDHLLSLPAAGVVLSCLAAATWLVLRLRLGVLMIALTSAVRTVSLISLERFKVAWRPYLAYLAGVLGILLARYVEQILPQSAEAAPREHLGSQLIAGTKEDIPVFKRRRRSSSVVSAEMSGCSSKSHRRTSLPCIPREQLMGHSEWDHKRGPRGSQSSGTSITVDIAVMGEAHGLITDLLADPSLPPNVCTSLRAVSNLLSTQLTFQAIHKPRVNPVTSLSENYTCSDSEESSEKDKLAIPKRLRRSLPPGLLRRVSSTWTTTTSATGLPTLEPAPVRRDRSTSIKLQEAPSSSPDSWNNPVMMTLTKSRSFTSSYAISAANHVKAKKQSRPGALAKISPLSSPCSSPLQGTPASSLVSKISAVQFPESADTTAKQSLGSHRALTYTQSAPDLSPQILTPPVICSSCGRPYSQGNPADEPLERSGVATRTPSRTDDTAQVTSDYETNNNSDSSDIVQNEDETECLREPLRKASACSTYAPETMMFLDKPILAPEPLVMDNLDSIMEQLNTWNFPIFDLVENIGRKCGRILSQVSYRLFEDMGLFEAFKIPIREFMNYFHALEIGYRDIPYHNRIHATDVLHAVWYLTTQPIPGLSTVINDHGSTSDSDSDSGFTHGHMGYVFSKTYNVTDDKYGCLSGNIPALELMALYVAAAMHDYDHPGRTNAFLVATSAPQAVLYNDRSVLENHHAAAAWNLFMSRPEYNFLINLDHVEFKHFRFLVIEAILATDLKKHFDFVAKFNGKVNDDVGIDWTNENDRLLVCQMCIKLADINGPAKCKELHLQWTDGIVNEFYEQGDEEASLGLPISPFMDRSAPQLANLQESFISHIVGPLCNSYDSAGLMPGKWVEDSDESGDTDDPEEEEEEAPAPNEEETCENNESPKKKTFKRRKIYCQITQHLLQNHKMWKKVIEEEQRLAGIENQSLDQTPQSHSSEQIQAIKEEEEEKGKPRGEEIPTQKPDQ

SEQ ID NO: 62885 - protein, 1112 aa, Homo sapiens
  Payload ID: 12554
  Gene Symbol: PDE3B
  Gene Name: phosphodiesterase 3B, cGMP-inhibited
  Uniprot ID: Q13370
  ENSP ID: ENSP00000282096
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQVISSLRSISSLMGAFSGSCRPKINPLTPFPGFYPCSEIEDPAEKGDRKLNKGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 62886 - protein, 1061 aa, Homo sapiens
  Payload ID: 12554
  Gene Symbol: PDE3B
  Gene Name: phosphodiesterase 3B, cGMP-inhibited
  Uniprot ID: Q13370
  ENSP ID: ENSP00000388644
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 62887 - protein, 860 aa, Homo sapiens
  Payload ID: 12555
  Gene Symbol: PDE4A
  Gene Name: phosphodiesterase 4A, cAMP-specific
  Uniprot ID: P27815
  ENSP ID: ENSP00000293683
MARPRGLGRIPELQLVAFPVAVAAEDEAFLPEPLAPRAPRRPRSPPSSPVFFASPSPTFRRRLRLLRSCQDLGRQAWAGAGFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 62888 - protein, 647 aa, Homo sapiens
  Payload ID: 12555
  Gene Symbol: PDE4A
  Gene Name: phosphodiesterase 4A, cAMP-specific
  Uniprot ID: P27815
  ENSP ID: ENSP00000341007
MPLVDFFCETCSKPWLVGWWDQFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 62889 - protein, 886 aa, Homo sapiens
  Payload ID: 12555
  Gene Symbol: PDE4A
  Gene Name: phosphodiesterase 4A, cAMP-specific
  Uniprot ID: P27815
  ENSP ID: ENSP00000370078
MEPPTVPSERSLSLSLPGPREGQATLKPPPQHLWRQPRTPIRIQQRGYSDSAERAERERQPHRPIERADAMDTSDRPGLRTTRMSWPSSFHGTGTGSGGAGGGSSRRFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 62890 - protein, 825 aa, Homo sapiens
  Payload ID: 12555
  Gene Symbol: PDE4A
  Gene Name: phosphodiesterase 4A, cAMP-specific
  Uniprot ID: P27815
  ENSP ID: ENSP00000394754
MRSGAAPRARPRPPALALPPTGPESLTHFPFSDEDTRRHPPGRSVSFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 62891 - protein, 96 aa, Homo sapiens
  Payload ID: 12555
  Gene Symbol: PDE4A
  Gene Name: phosphodiesterase 4A, cAMP-specific
  ENSP ID: ENSP00000465792
MPLVDFFCETCSKPWLVGWWDQFKRMLNRELTHLSEMSRSGNQVSEYISTTFLGSVHGPGDSRRPLRGCHPRCGSPWGLQPVPHQHQFGAGAHVQR

SEQ ID NO: 62892 - protein, 278 aa, Homo sapiens
  Payload ID: 12555
  Gene Symbol: PDE4A
  Gene Name: phosphodiesterase 4A, cAMP-specific
  ENSP ID: ENSP00000467137
ETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLK

SEQ ID NO: 62893 - protein, 864 aa, Homo sapiens
  Payload ID: 12555
  Gene Symbol: PDE4A
  Gene Name: phosphodiesterase 4A, cAMP-specific
  Uniprot ID: P27815
  ENSP ID: ENSP00000468507
MKRSRSALSVAGTGDERSRETPESDRANMLGADLRRPRRRLSSGPGLGWAQPEPSDPGVPLPPRPTTLPLLIPPRISITRAENDSFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 62894 - protein, 736 aa, Homo sapiens
  Payload ID: 12556
  Gene Symbol: PDE4B
  Gene Name: phosphodiesterase 4B, cAMP-specific
  Uniprot ID: Q07343
  ENSP ID: ENSP00000332116
MKKSRSVMTVMADDNVKDYFECSLSKSYSSSSNTLGIDLWRGRRCCSGNLQLPPLSQRQSERARTPEGDGISRPTTLPLTTLPSIAITTVSQECFDVENGPSPGRSPLDPQASSSAGLVLHATFPGHSQRRESFLYRSDSDYDLSPKAMSRNSSLPSEQHGDDLIVTPFAQVLASLRSVRNNFTILTNLHGTSNKRSPAASQPPVSRVNPQEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 62895 - protein, 736 aa, Homo sapiens; identical to SEQ ID NO: 62894
  Payload ID: 12556
  Gene Symbol: PDE4B
  Gene Name: phosphodiesterase 4B, cAMP-specific
  Uniprot ID: Q07343
  ENSP ID: ENSP00000342637

SEQ ID NO: 62896 - protein, 564 aa, Homo sapiens
  Payload ID: 12556
  Gene Symbol: PDE4B
  Gene Name: phosphodiesterase 4B, cAMP-specific
  Uniprot ID: Q07343
  ENSP ID: ENSP00000360084
MKEHGGTFSSTGISGGSGDSAMDSLQPLQPNYMPVCLFAEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 62897 - protein, 721 aa, Homo sapiens
  Payload ID: 12556
  Gene Symbol: PDE4B
  Gene Name: phosphodiesterase 4B, cAMP-specific
  Uniprot ID: Q07343
  ENSP ID: ENSP00000392947
MTAKDSSKELTASEPEVCIKTFKEQMHLELELPRLPGNRPTSPKISPRSSPRNSPCFFRKLLVNKSIRQRRRFTVAHTCFDVENGPSPGRSPLDPQASSSAGLVLHATFPGHSQRRESFLYRSDSDYDLSPKAMSRNSSLPSEQHGDDLIVTPFAQVLASLRSVRNNFTILTNLHGTSNKRSPAASQPPVSRVNPQEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 62898 - protein, 147 aa, Homo sapiens
  Payload ID: 12556
  Gene Symbol: PDE4B
  Gene Name: phosphodiesterase 4B, cAMP-specific
  ENSP ID: ENSP00000397548
MSFDVENGPSPGRSPLDPQASSSAGLVLHATFPGHSQRRESFLYRSDSDYDLSPKAMSRNSSLPSEQHGDDLIVTPFAQVLASLRSVRNNFTILTNLHGTSNKRSPAASQPPVSRVNPQEESYQKLAMETLEELDWCLDQLETIQTY

SEQ ID NO: 62899 - protein, 137 aa, Homo sapiens
  Payload ID: 12556
  Gene Symbol: PDE4B
  Gene Name: phosphodiesterase 4B, cAMP-specific
  ENSP ID: ENSP00000431909
METLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVA

SEQ ID NO: 62900 - protein, 66 aa, Homo sapiens
  Payload ID: 12556
  Gene Symbol: PDE4B
  Gene Name: phosphodiesterase 4B, cAMP-specific
  ENSP ID: ENSP00000432400
  MOD_RES (1)..(1): Any amino acid
XHGDDLIVTPFAQVLASLRSVRNNFTILTNLHGTSNKRSPAASQPPVSRVNPQGRPCHKVYLDVSR

SEQ ID NO: 62901 - protein, 503 aa, Homo sapiens
  Payload ID: 12556
  Gene Symbol: PDE4B
  Gene Name: phosphodiesterase 4B, cAMP-specific
  Uniprot ID: Q07343
  ENSP ID: ENSP00000432592
MPEANYLLSVSWGYIKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 62902 - protein, 152 aa, Homo sapiens
  Payload ID: 12556
  Gene Symbol: PDE4B
  Gene Name: phosphodiesterase 4B, cAMP-specific
  ENSP ID: ENSP00000436104
METLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAI

SEQ ID NO: 62903 - protein, 143 aa, Homo sapiens
  Payload ID: 12556
  Gene Symbol: PDE4B
  Gene Name: phosphodiesterase 4B, cAMP-specific
  ENSP ID: ENSP00000437249
METLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNR

SEQ ID NO: 62904 - protein, 680 aa, Homo sapiens
  Payload ID: 12557
  Gene Symbol: PDE4C
  Gene Name: phosphodiesterase 4C, cAMP-specific
  Uniprot ID: Q08493
  ENSP ID: ENSP00000262805
MQGPPAPAPVPGPGSPRGSPRGSPGLFRKLLVNQSIRLQRRFTVAHPLCFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 62905 - protein, 712 aa, Homo sapiens
  Payload ID: 12557
  Gene Symbol: PDE4C
  Gene Name: phosphodiesterase 4C, cAMP-specific
  Uniprot ID: Q08493
  ENSP ID: ENSP00000347689
MENLGVGEGAEACSRLSRSRGRHSMTRAPKHLWRQPRRPIRIQQRFYSDPDKSAGCRERDLSPRPELRKSRLSWPVSSCRRFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 62906 - protein, 606 aa, Homo sapiens
  Payload ID: 12557
  Gene Symbol: PDE4C
  Gene Name: phosphodiesterase 4C, cAMP-specific
  Uniprot ID: Q08493
  ENSP ID: ENSP00000402091
MQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 62907 - protein, 481 aa, Homo sapiens
  Payload ID: 12557
  Gene Symbol: PDE4C
  Gene Name: phosphodiesterase 4C, cAMP-specific
  ENSP ID: ENSP00000439470
MASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 62908 - protein, 712 aa, Homo sapiens; identical to SEQ ID NO: 62905
  Payload ID: 12557
  Gene Symbol: PDE4C
  Gene Name: phosphodiesterase 4C, cAMP-specific
  Uniprot ID: Q08493
  ENSP ID: ENSP00000469696

SEQ ID NO: 62909 - protein, 712 aa, Homo sapiens; identical to SEQ ID NO: 62905
  Payload ID: 12557
  Gene Symbol: PDE4C
  Gene Name: phosphodiesterase 4C, cAMP-specific
  Uniprot ID: Q08493
  ENSP ID: ENSP00000470210

SEQ ID NO: 62910 - protein, 93 aa, Homo sapiens
  Payload ID: 12557
  Gene Symbol: PDE4C
  Gene Name: phosphodiesterase 4C, cAMP-specific
  ENSP ID: ENSP00000472034
MENLGVGEGAEACSRLSRSRGRHSMTRAPKHLWRQPRRPIRIQQRFYSDPDKSAGCRERDLSPRPELRKSRLSWPVSSCRRFDLENGLSCGRR

SEQ ID NO: 62911 - protein, 231 aa, Homo sapiens
  Payload ID: 12557
  Gene Symbol: PDE4C
  Gene Name: phosphodiesterase 4C, cAMP-specific
  ENSP ID: ENSP00000473713
MQGPPAPAPVPGPGSPRGSPRGSPGLFRKLLVNQSIRLQRRFTVAHPLCFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKGHGAEAGIGDARRAGLVPGSVGDAADPALGGGDGLQQVQADPEPGVDPPVRNQPLREPGVRVHLPDLPGPADRGGAAQGDR

SEQ ID NO: 62912 - protein, 11 aa, Homo sapiens
  Payload ID: 12557
  Gene Symbol: PDE4C
  Gene Name: phosphodiesterase 4C, cAMP-specific
  ENSP ID: ENSP00000473937
  MOD_RES (1)..(1): Any amino acid
XARQQCLGAAK

SEQ ID NO: 62913 - protein, 427 aa, Homo sapiens
  Payload ID: 12557
  Gene Symbol: PDE4C
  Gene Name: phosphodiesterase 4C, cAMP-specific
  ENSP ID: ENSP00000474591
MPRSSQFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 62914 - protein, 89 aa, Homo sapiens
  Payload ID: 12557
  Gene Symbol: PDE4C
  Gene Name: phosphodiesterase 4C, cAMP-specific
  ENSP ID: ENSP00000474849
  MOD_RES (1)..(1): Any amino acid
XARQQCLGAANPAPAKTITPSGMDPTTLILQMRRLRPRDLMVTQALGEQIWNLGPGVLGGPRGNSFRVQMKRRSRERRGVPERGGWAGP

SEQ ID NO: 62915 - protein, 482 aa, Homo sapiens
  Payload ID: 12557
  Gene Symbol: PDE4C
  Gene Name: phosphodiesterase 4C, cAMP-specific
  ENSP ID: ENSP00000476923
MPRSSQFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 62916 - protein, 82 aa, Homo sapiens
  Payload ID: 12557
  Gene Symbol: PDE4C
  Gene Name: phosphodiesterase 4C, cAMP-specific
  ENSP ID: ENSP00000476961
MQAPVPHSQRRESFLYRSDSDYELSPKAMSRNSSVASDLHGEDMIVTPFAQVLASLRTVRSNVAALARQQCLGAAKQGPVGN

SEQ ID NO: 62917 - protein, 1132 aa, Homo sapiens
  Payload ID: 12558
  Gene Symbol: PDE4DIP
  Gene Name: phosphodiesterase 4D interacting protein
  ENSP ID: ENSP00000316434
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQL

SEQ ID NO: 62918 - protein, 173 aa, Homo sapiens
  Payload ID: 12558
  Gene Symbol: PDE4DIP
  Gene Name: phosphodiesterase 4D interacting protein
  Uniprot ID: Q5VU43
  ENSP ID: ENSP00000358353
MSNGYRTLSQHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDK

SEQ ID NO: 62919 - protein, 969 aa, Homo sapiens
  Payload ID: 12558
  Gene Symbol: PDE4DIP
  Gene Name: phosphodiesterase 4D interacting protein
  ENSP ID: ENSP00000358355
MSNGYRTLSQHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQL

SEQ ID NO: 62920 - protein, 988 aa, Homo sapiens
  Payload ID: 12558
  Gene Symbol: PDE4DIP
  Gene Name: phosphodiesterase 4D interacting protein
  ENSP ID: ENSP00000358357
MSNGYRTLSQHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQVSQCQGLGLPGWTAHSPSEV

SEQ ID NO: 62921 - protein, 2346 aa, Homo sapiens
  Payload ID: 12558
  Gene Symbol: PDE4DIP
  Gene Name: phosphodiesterase 4D interacting protein
  ENSP ID: ENSP00000358360
MSNGYRTLSQHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 62922 - protein, 2362 aa, Homo sapiens
  Payload ID: 12558
  Gene Symbol: PDE4DIP
  Gene Name: phosphodiesterase 4D interacting protein
  ENSP ID: ENSP00000358363
MSNGYRTLSQHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEEPCKKRSHQKSLKQQERWACPPFVQLPIC

SEQ ID NO: 62923 - protein, 95 aa, Homo sapiens
  Payload ID: 12558
  Gene Symbol: PDE4DIP
  Gene Name: phosphodiesterase 4D interacting protein
  ENSP ID: ENSP00000431596
  MOD_RES (1)..(1): Any amino acid
XAERQLYSSLVKFHAHPESSERDRTLQVELEGAQVLRSRLEEVLGRSLERLNRLETLAAIGGAAAGDDTEDTSTEFTDSIEEEAAHHSHQQPSFL

SEQ ID NO: 62924 - protein, 51 aa, Homo sapiens
  Payload ID: 12558
  Gene Symbol: PDE4DIP
  Gene Name: phosphodiesterase 4D interacting protein
  ENSP ID: ENSP00000431777
MFLCQGFRKYLPEHLNDLKKENFSLKLRIYFLEERMQQKYEASREDIYKRG

SEQ ID NO: 62925 - protein, 309 aa, Homo sapiens
  Payload ID: 12558
  Gene Symbol: PDE4DIP
  Gene Name: phosphodiesterase 4D interacting protein
  ENSP ID: ENSP00000432498
  MOD_RES (1)..(1): Any amino acid
XEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHE

SEQ ID NO: 62926 - protein, 1116 aa, Homo sapiens
  Payload ID: 12558
  Gene Symbol: PDE4DIP
  Gene Name: phosphodiesterase 4D interacting protein
  ENSP ID: ENSP00000433392
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGGELESVRIHHKHAY

SEQ ID NO: 62927 - protein, 48 aa, Homo sapiens
  Payload ID: 12558
  Gene Symbol: PDE4DIP
  Gene Name: phosphodiesterase 4D interacting protein
  ENSP ID: ENSP00000435483
MSNGYRTLSQHLNDLKKENFSLKLRIYFLEERMQQKYEASREDIYKRG

SEQ ID NO: 62928 - protein, 186 aa, Homo sapiens
  Payload ID: 12558
  Gene Symbol: PDE4DIP
  Gene Name: phosphodiesterase 4D interacting protein
  ENSP ID: ENSP00000435920
MFLCQGFRKYLPEHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLA

SEQ ID NO: 62929 - protein, 87 aa, Homo sapiens
  Payload ID: 12558
  Gene Symbol: PDE4DIP
  Gene Name: phosphodiesterase 4D interacting protein
  ENSP ID: ENSP00000436694
  MOD_RES (1)..(1): Any amino acid
XVDERSRLNEALQAERQLYSSLVKFHAHPERFSCVPSSPGCWYEFPSSGLPQLCFLYSWLRNAHNQQSKWLGFGYFSSNEDPSQARG

SEQ ID NO: 62930 - protein, 740 aa, Homo sapiens
  Payload ID: 12558
  Gene Symbol: PDE4DIP
  Gene Name: phosphodiesterase 4D interacting protein
  ENSP ID: ENSP00000436791
MTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGGELESVRIHHKHAY

SEQ ID NO: 62931 - protein, 79 aa, Homo sapiens
  Payload ID: 12558
  Gene Symbol: PDE4DIP
  Gene Name: phosphodiesterase 4D interacting protein
  ENSP ID: ENSP00000437202
MWRISTVRMKLSSDASLRSDSRRRSMFMSSWRIRSSFCRRLAKNEAARMAALVEAEKECNLELSEKLKGVTKNWEDVPG

SEQ ID NO: 62932 - protein, 2482 aa, Homo sapiens
  Payload ID: 12558
  Gene Symbol: PDE4DIP
  Gene Name: phosphodiesterase 4D interacting protein
  ENSP ID: ENSP00000462316
MKGTDSGSCCRRRCDFGCCCRASRRAHYTPYRSGDATRTPQSPRQTPSRERRRPEPAGSWAAAAEEEEAAAAATPWMRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLSESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 62933 - protein, 2240 aa, Homo sapiens
  Payload ID: 12558
  Gene Symbol: PDE4DIP
  Gene Name: phosphodiesterase 4D interacting protein
  ENSP ID: ENSP00000479409
MEQTWTRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGELDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 62934 - protein, 219 aa, Homo sapiens
  Payload ID: 12558
  Gene Symbol: PDE4DIP
  Gene Name: phosphodiesterase 4D interacting protein
  ENSP ID: ENSP00000479601
MKGTDSGSCCRRRCDFGCCCRASRRAHYTPYRSGDATRTPQSPRQTPSRERRRPEPAGSWAAAAEEEEAAAAATPWMRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRQLPTQTLGPADFGGLQLNLHLLLEWSSLCKRGWWK

SEQ ID NO: 62935 - protein, 143 aa, Homo sapiens
  Payload ID: 12558
  Gene Symbol: PDE4DIP
  Gene Name: phosphodiesterase 4D interacting protein
  ENSP ID: ENSP00000480245
MKPHSRKGDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNIELKVEVESLKRELQDKKQHLDKTWADV

SEQ ID NO: 62936 - protein, 82 aa, Homo sapiens
  Payload ID: 12558
  Gene Symbol: PDE4DIP
  Gene Name: phosphodiesterase 4D interacting protein
  ENSP ID: ENSP00000480290
MEQTWTRDYFAEDDGEMVPRTSHTAAFLSDTKDRGPPVQSQIWRSGEKVPFVQTYSLRAFEKPPQVQTQALRDFEKVSHVSG

SEQ ID NO: 62937 - protein, 114 aa, Homo sapiens
  Payload ID: 12558
  Gene Symbol: PDE4DIP
  Gene Name: phosphodiesterase 4D interacting protein
  ENSP ID: ENSP00000480590
MEQTWTRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRG

SEQ ID NO: 62938 - protein, 2431 aa, Homo sapiens
  Payload ID: 12558
  Gene Symbol: PDE4DIP
  Gene Name: phosphodiesterase 4D interacting protein
  ENSP ID: ENSP00000480806
MKGTDSGSCCRRRCDFGCCCRASRRAHYTPYRSGDATRTPQSPRQTPSRERRRPEPAGSWAAAAEEEEAAAAATPWMRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGRLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLSESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPRKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 62939 - protein, 176 aa, Homo sapiens
  Payload ID: 12558
  Gene Symbol: PDE4DIP
  Gene Name: phosphodiesterase 4D interacting protein
  ENSP ID: ENSP00000481731
MFLCQGFRKYLPEHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDK

SEQ ID NO: 62940 - protein, 310 aa, Homo sapiens
  Payload ID: 12558
  Gene Symbol: PDE4DIP
  Gene Name: phosphodiesterase 4D interacting protein
  Uniprot ID: Q5VU43
  ENSP ID: ENSP00000482121
MKGTDSGSCCRRRCDFGCCCRASRRAHYTPYRSGDATRTPQSPRQTPSRERRRPEPAGSWAAAAEEEEAAAAATPWMRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDK

SEQ ID NO: 62941 - protein, 157 aa, Homo sapiens
  Payload ID: 12558
  Gene Symbol: PDE4DIP
  Gene Name: phosphodiesterase 4D interacting protein
  ENSP ID: ENSP00000483081
MEQTWTRDYFAEDDGEMVPRTSHTAAFLSDTKDRGPPVQSQIWRSGEKVPFVQTYSLRAFEKPPQVQTQALRDFEKTWRVCMVIKRLLKTKPPNSCVVLVGEARMLTPQPPPFFVFFFSPFGSAVMQKGQAELQSSSKLCGVLSKGQPACMFLFIER

SEQ ID NO: 62942 - protein, 66 aa, Homo sapiens
  Payload ID: 12558
  Gene Symbol: PDE4DIP
  Gene Name: phosphodiesterase 4D interacting protein
  ENSP ID: ENSP00000483413
  MOD_RES (1)..(1): Any amino acid
XFVQTYSLRAFEKPPQVQTQALRDFEKHLNDLKKENFSLKLRIYFLEERMQQKYEASREDIYKREN

SEQ ID NO: 62943 - protein, 137 aa, Homo sapiens
  Payload ID: 12558
  Gene Symbol: PDE4DIP
  Gene Name: phosphodiesterase 4D interacting protein
  ENSP ID: ENSP00000484652
MEQTWTRDYFAEDDGEMVPRTSHTAAFLSDTKDRGPPVQSQIWRSGEKVPFVQTYSLRAFEKPPQQQVALLDLQSALFCSQLEIQKLQRVVRQKERQLADAKQCVQFVEAAAHESEQQKEASWKHNQELRKALQQLQ

SEQ ID NO: 62944 - protein, 215 aa, Homo sapiens
  Payload ID: 12559
  Gene Symbol: PDE4D
  Gene Name: phosphodiesterase 4D, cAMP-specific
  Uniprot ID: Q08499
  ENSP ID: ENSP00000308485
MAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITGLYNGIIAFL

SEQ ID NO: 62945 - protein, 518 aa, Homo sapiens
  Payload ID: 12559
  Gene Symbol: PDE4D
  Gene Name: phosphodiesterase 4D, cAMP-specific
  Uniprot ID: Q08499
  ENSP ID: ENSP00000321739
MPEANYLLSVSWGYIKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 62946 - protein, 809 aa, Homo sapiens
  Payload ID: 12559
  Gene Symbol: PDE4D
  Gene Name: phosphodiesterase 4D, cAMP-specific
  Uniprot ID: Q08499
  ENSP ID: ENSP00000345502
MEAEGSSAPARAGSGEGSDSAGGATLKAPKHLWRHEQHHQYPLRQPQFRLLHPHHHLPPPPPPSPQPQPQCPLQPPPPPPLPPPPPPPGAARGRYASSGATGRVRHRGYSDTERYLYCRAMDRTSYAVETGHRPGLKKSRMSWPSSFQGLRRFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 62947 - protein, 507 aa, Homo sapiens
  Payload ID: 12559
  Gene Symbol: PDE4D
  Gene Name: phosphodiesterase 4D, cAMP-specific
  Uniprot ID: Q08499
  ENSP ID: ENSP00000351800
MASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 62948 - protein, 673 aa, Homo sapiens
  Payload ID: 12559
  Gene Symbol: PDE4D
  Gene Name: phosphodiesterase 4D, cAMP-specific
  Uniprot ID: Q08499
  ENSP ID: ENSP00000353152
MMHVNNFPFRRHSWICFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 62949 - protein, 687 aa, Homo sapiens
  Payload ID: 12559
  Gene Symbol: PDE4D
  Gene Name: phosphodiesterase 4D, cAMP-specific
  Uniprot ID: Q08499
  ENSP ID: ENSP00000384806
MAFVWDPLGATVPGPSTRAKSRLRFSKSYSFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 62950 - protein, 422 aa, Homo sapiens
  Payload ID: 12559
  Gene Symbol: PDE4D
  Gene Name: phosphodiesterase 4D, cAMP-specific
  ENSP ID: ENSP00000421013
MASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPE

SEQ ID NO: 62951 - protein, 74 aa, Homo sapiens
  Payload ID: 12559
  Gene Symbol: PDE4D
  Gene Name: phosphodiesterase 4D, cAMP-specific
  ENSP ID: ENSP00000421829
MKRNTCDLLSRSKSASEETLHSSNEEEDPFRGMEPYLVRRLSCRNIQLPPLAFRQLEQADLKSESENIQRPTSL

SEQ ID NO: 62952 - protein, 748 aa, Homo sapiens
  Payload ID: 12559
  Gene Symbol: PDE4D
  Gene Name: phosphodiesterase 4D, cAMP-specific
  Uniprot ID: Q08499
  ENSP ID: ENSP00000423094
MKRNTCDLLSRSKSASEETLHSSNEEEDPFRGMEPYLVRRLSCRNIQLPPLAFRQLEQADLKSESENIQRPTSLPLKILPLIAITSAESSGFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 62953 - protein, 17 aa, Homo sapiens
  Payload ID: 12559
  Gene Symbol: PDE4D
  Gene Name: phosphodiesterase 4D, cAMP-specific
  ENSP ID: ENSP00000423555
MKRNTCDLLSRSKSDKK

SEQ ID NO: 62954 - protein, 29 aa, Homo sapiens
  Payload ID: 12559
  Gene Symbol: PDE4D
  Gene Name: phosphodiesterase 4D, cAMP-specific
  ENSP ID: ENSP00000424281
MKRNTCDLLSRSKSPAYCDLIFLLWPLKL

SEQ ID NO: 62955 - protein, 745 aa, Homo sapiens
  Payload ID: 12559
  Gene Symbol: PDE4D
  Gene Name: phosphodiesterase 4D, cAMP-specific
  Uniprot ID: Q08499
  ENSP ID: ENSP00000424852
MAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 62956 - protein, 679 aa, Homo sapiens
  Payload ID: 12559
  Gene Symbol: PDE4D
  Gene Name: phosphodiesterase 4D, cAMP-specific
  Uniprot ID: Q08499
  ENSP ID: ENSP00000425605
MSIIMKPRSRSTSSLRTAEAVCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 62957 - protein, 81 aa, Homo sapiens
  Payload ID: 12559
  Gene Symbol: PDE4D
  Gene Name: phosphodiesterase 4D, cAMP-specific
  ENSP ID: ENSP00000425910
MKRNTCDLLSRSKSASEETLHSSNEEEDPFRGMEPYLVRRLSCRNIQLPPLAFRQLEQADLKSESENIQRPTSLPLKILPL

SEQ ID NO: 62958 - protein, 219 aa, Homo sapiens
  Payload ID: 12559
  Gene Symbol: PDE4D
  Gene Name: phosphodiesterase 4D, cAMP-specific
  Uniprot ID: Q08499
  ENSP ID: ENSP00000425917
MAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITGSWMELNPYTLLDM

SEQ ID NO: 62959 - protein, 678 aa, Homo sapiens [sequence omitted]

SEQ ID NO: 62960 - protein, 833 aa, Homo sapiens
  Payload ID: 12560
  Gene Symbol: PDE5A
  Gene Name: phosphodiesterase 5A, cGMP-specific
  Uniprot ID: O76074
  ENSP ID: ENSP00000264805
MLPFGDKTREMVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 62961 - protein, 875 aa, Homo sapiens
  Payload ID: 12560
  Gene Symbol: PDE5A
  Gene Name: phosphodiesterase 5A, cGMP-specific
  Uniprot ID: O76074
  ENSP ID: ENSP00000347046
MERAGPSFGQQRQQQQPQQQKQQQRDQDSVEAWLDDHWDFTFSYFVRKATREMVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 62962 - protein, 823 aa, Homo sapiens
  Payload ID: 12560
  Gene Symbol: PDE5A
  Gene Name: phosphodiesterase 5A, cGMP-specific
  ENSP ID: ENSP00000377957
MVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 62963 - protein, 224 aa, Homo sapiens
  Payload ID: 12560
  Gene Symbol: PDE5A
  Gene Name: phosphodiesterase 5A, cGMP-specific
  ENSP ID: ENSP00000416309
MVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHRE

SEQ ID NO: 62964 - protein, 185 aa, Homo sapiens
  Payload ID: 12560
  Gene Symbol: PDE5A
  Gene Name: phosphodiesterase 5A, cGMP-specific
  ENSP ID: ENSP00000425810
  MOD_RES (1)..(1): Any amino acid
XALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEVFI

SEQ ID NO: 62965 - protein, 860 aa, Homo sapiens
  Payload ID: 12561
  Gene Symbol: PDE6A
  Gene Name: phosphodiesterase 6A, cGMP-specific, rod, alpha
  Uniprot ID: P16499
  ENSP ID: ENSP00000255266
MGEVTAEEVEKFLDSNIGFAKQYYNLHYRAKLISDLLGAKEAAVDFSNYHSPSSMEESEIIFDLLRDFQENLQTEKCIFNVMKKLCFLLQADRMSLFMYRTRNGIAELATRLFNVHKDAVLEDCLVMPDQEIVFPLDMGIVGHVAHSKKIANVPNTEEDEHFCDFVDILTEYKTKNILASPIMNGKDVVAIIMAVNKVDGSHFTKRDEEILLKYLNFANLIMKVYHLSYLHNCETRRGQILLWSGSKVFEELTDIERQFHKALYTVRAFLNCDRYSVGLLDMTKQKEFFDVWPVLMGEVPPYSGPRTPDGREINFYKVIDYILHGKEDIKVIPNPPPDHWALVSGLPAYVAQNGLICNIMNAPAEDFFAFQKEPLDESGWMIKNVLSMPIVNKKEEIVGVATFYNRKDGKPFDEMDETLMESLTQFLGWSVLNPDTYESMNKLENRKDIFQDIVKYHVKCDNEEIQKILKTREVYGKEPWECEEEELAEILQAELPDADKYEINKFHFSDLPLTELELVKCGIQMYYELKVVDKFHIPQEALVRFMYSLSKGYRKITYHNWRHGFNVGQTMFSLLVTGKLKRYFTDLEALAMVTAAFCHDIDHRGTNNLYQMKSQNPLAKLHGSSILERHHLEFGKTLLRDESLNIFQNLNRRQHEHAIHMMDIAIIATDLALYFKKRTMFQKIVDQSKTYESEQEWTQYMMLEQTRKEIVMAMMMTACDLSAITKPWEVQSQVALLVAAEFWEQGDLERTVLQQNPIPMMDRNKADELPKLQVGFIDFVCTFVYKEFSRFHEEITPMLDGITNNRKEWKALADEYDAKMKVQEEKKQKQQSAKSAAAGNQPGGNPSPGGATTSKSCCIQ

SEQ ID NO: 62966 - protein, 779 aa, Homo sapiens
  Payload ID: 12561
  Gene Symbol: PDE6A
  Gene Name: phosphodiesterase 6A, cGMP-specific, rod, alpha
  ENSP ID: ENSP00000478060
MGEVTAEEVEKFLDSNIGFAKQYYNLHYRAKLISDLLGAKEAAVDFSNYHSPSSMEESEIIFDLLRDFQENLQTEKCIFNVMKKLCFLLQADRMSLFMYRTRNGIAELATRLFNVHKDAVLEDCLVMPDQEIVFPLDMGIVGHVAHSKKIANVPNTEEILLWSGSKVFEELTDIERQFHKALYTVRAFLNCDRYSVGLLDMTKQKEFFDVWPVLMGEVPPYSGPRTPDGREINFYKVIDYILHGKEDIKVIPNPPPDHWALVSGLPAYVAQNGLICNIMNAPAEDFFAFQKEPLDESGWMIKNVLSMPIVNKKEEIVGVATFYNRKDGKPFDEMDETLMESLTQFLGWSVLNPDTYESMNKLENRKDIFQDIVKYHVKCDNEEIQKILKTREVYGKEPWECEEEELAEILQAELPDADKYEINKFHFSDLPLTELELVKCGIQMYYELKVVDKFHIPQEALVRFMYSLSKGYRKITYHNWRHGFNVGQTMFSLLVTGKLKRYFTDLEALAMVTAAFCHDIDHRGTNNLYQMKSQNPLAKLHGSSILERHHLEFGKTLLRDESLNIFQNLNRRQHEHAIHMMDIAIIATDLALYFKKRTMFQKIVDQSKTYESEQEWTQYMMLEQTRKEIVMAMMMTACDLSAITKPWEVQSQVALLVAAEFWEQGDLERTVLQQNPIPMMDRNKADELPKLQVGFIDFVCTFVYKEFSRFHEEITPMLDGITNNRKEWKALADEYDAKMKVQEEKKQKQQSAKSAAAGNQPGGNPSPGGATTSKSCCIQ

SEQ ID NO: 62967 - protein, 779 aa, Homo sapiens; identical to SEQ ID NO: 62966
  Payload ID: 12561
  Gene Symbol: PDE6A
  Gene Name: phosphodiesterase 6A, cGMP-specific, rod, alpha
  ENSP ID: ENSP00000482774

SEQ ID NO: 62968 - protein, 853 aa, Homo sapiens
  Payload ID: 12562
  Gene Symbol: PDE6B
  Gene Name: phosphodiesterase 6B, cGMP-specific, rod, beta
  Uniprot ID: P35913
  ENSP ID: ENSP00000255622
MSLSEEQARSFLDQNPDFARQYFGKKLSPENVAAACEDGCPPDCDSLRDLCQVEESTALLELVQDMQESINMERVVFKVLRRLCTLLQADRCSLFMYRQRNGVAELATRLFSVQPDSVLEDCLVPPDSEIVFPLDIGVVGHVAQTKKMVNVEDVAECPHFSSFADELTDYKTKNMLATPIMNGKDVVAVIMAVNKLNGPFFTSEDEDVFLKYLNFATLYLKIYHLSYLHNCETRRGQVLLWSANKVFEELTDIERQFHKAFYTVRAYLNCERYSVGLLDMTKEKEFFDVWSVLMGESQPYSGPRTPDGREIVFYKVIDYVLHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKGTEICNGGPAPKSSTCCIL

SEQ ID NO: 62969 - protein, 575 aa, Homo sapiens
  Payload ID: 12562
  Gene Symbol: PDE6B
  Gene Name: phosphodiesterase 6B, cGMP-specific, rod, beta
  Uniprot ID: P35913
  ENSP ID: ENSP00000406334
MTKEKEFFDVWSVLMGESQPYSGPRTPDGREIVFYKVIDYVLHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 62970 - protein, 149 aa, Homo sapiens
  Payload ID: 12562
  Gene Symbol: PDE6B
  Gene Name: phosphodiesterase 6B, cGMP-specific, rod, beta
  ENSP ID: ENSP00000417178
  MOD_RES (1)..(1): Any amino acid
XAITKPWEVQSKVALLVAAEFWEQGDLERTVLDQQPIPMMDRNKAAELPKLQVGFIDFVCTFVYKEFSRFHEEILPMFDRLQNNRKEWKALADDRHRNLQWRPSTQVFNLLYPVSTGPMGTLWLPQSSPTRIWVLPVAICYKRLGSPRK

SEQ ID NO: 62971 - protein, 144 aa, Homo sapiens
  Payload ID: 12562
  Gene Symbol: PDE6B
  Gene Name: phosphodiesterase 6B, cGMP-specific, rod, beta
  ENSP ID: ENSP00000417852
TLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYK

SEQ ID NO: 62972 - protein, 97 aa, Homo sapiens
  Payload ID: 12562
  Gene Symbol: PDE6B
  Gene Name: phosphodiesterase 6B, cGMP-specific, rod, beta
  ENSP ID: ENSP00000418256
MTKEKEFFDVWSVLMGESQPYSGPRTPDGREIVFYKVIDYVLHGKEEIKVIPTPSADHWALASGLPSYVAESGFEGALDDSGWLIKNVLSMPIVNKK

SEQ ID NO: 62973 - protein, 41 aa, Homo sapiens
  Payload ID: 12562
  Gene Symbol: PDE6B
  Gene Name: phosphodiesterase 6B, cGMP-specific, rod, beta
  ENSP ID: ENSP00000418454
MTKEKEFFDVWSVLMGESQPYSGPRTPDGREIVFYKVIDYV

SEQ ID NO: 62974 - protein, 6 aa, Homo sapiens
  Payload ID: 12562
  Gene Symbol: PDE6B
  Gene Name: phosphodiesterase 6B, cGMP-specific, rod, beta
  ENSP ID: ENSP00000420228
MTKEKE

SEQ ID NO: 62975 - protein, 854 aa, Homo sapiens
  Payload ID: 12562
  Gene Symbol: PDE6B
  Gene Name: phosphodiesterase 6B, cGMP-specific, rod, beta
  Uniprot ID: P35913
  ENSP ID: ENSP00000420295
MSLSEEQARSFLDQNPDFARQYFGKKLSPENVAAACEDGCPPDCDSLRDLCQVEESTALLELVQDMQESINMERVVFKVLRRLCTLLQADRCSLFMYRQRNGVAELATRLFSVQPDSVLEDCLVPPDSEIVFPLDIGVVGHVAQTKKMVNVEDVAECPHFSSFADELTDYKTKNMLATPIMNGKDVVAVIMAVNKLNGPFFTSEDEDVFLKYLNFATLYLKIYHLSYLHNCETRRGQVLLWSANKVFEELTDIERQFHKAFYTVRAYLNCERYSVGLLDMTKEKEFFDVWSVLMGESQPYSGPRTPDGREIVFYKVIDYVLHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 62976 - protein, 858 aa, Homo sapiens
  Payload ID: 12563
  Gene Symbol: PDE6C
  Gene Name: phosphodiesterase 6C, cGMP-specific, cone, alpha prime
  Uniprot ID: P51160
  ENSP ID: ENSP00000360502
MGEINQVAVEKYLEENPQFAKEYFDRKLRVEVLGEIFKNSQVPVQSSMSFSELTQVEESALCLELLWTVQEEGGTPEQGVHRALQRLAHLLQADRCSMFLCRSRNGIPEVASRLLDVTPTSKFEDNLVGPDKEVVFPLDIGIVGWAAHTKKTHNVPDVKKNSHFSDFMDKQTGYVTKNLLATPIVVGKEVLAVIMAVNKVNASEFSKQDEEVFSKYLNFVSIILRLHHTSYMYNIESRRSQILMWSANKVFEELTDVERQFHKALYTVRSYLNCERYSIGLLDMTKEKEFYDEWPIKLGEVEPYKGPKTPDGREVNFYKIIDYILHGKEEIKVIPTPPADHWTLISGLPTYVAENGFICNMMNAPADEYFTFQKGPVDETGWVIKNVLSLPIVNKKEDIVGVATFYNRKDGKPFDEHDEYITETLTQFLGWSLLNTDTYDKMNKLENRKDIAQEMLMNQTKATPEEIKSILKFQEKLNVDVIDDCEEKQLVAILKEDLPDPRSAELYEFRFSDFPLTEHGLIKCGIRLFFEINVVEKFKVPVEVLTRWMYTVRKGYRAVTYHNWRHGFNVGQTMFTLLMTGRLKKYYTDLEAFAMLAAAFCHDIDHRGTNNLYQMKSTSPLARLHGSSILERHHLEYSKTLLQDESLNIFQNLNKRQFETVIHLFEVAIIATDLALYFKKRTMFQKIVDACEQMQTEEEAIKYVTVDPTKKEIIMAMMMTACDLSAITKPWEVQSQVALMVANEFWEQGDLERTVLQQQPIPMMDRNKRDELPKLQVGFIDFVCTFVYKEFSRFHKEITPMLSGLQNNRVEWKSLADEYDAKMKVIEEEAKKQEGGAEKAAEDSGGGDDKKSKTCLML

SEQ ID NO: 62977 - protein, 150 aa, Homo sapiens
  Payload ID: 12564
  Gene Symbol: PDE6D
  Gene Name: phosphodiesterase 6D, cGMP-specific, rod, delta
  Uniprot ID: O43924
  ENSP ID: ENSP00000287600
MSAKDERAREILRGFKLNWMNLRDAETGKILWQGTEDLSVPGVEHEARVPKKILKCKAVSRELNFSSTEQMEKFRLEQKVYFKGQCLEEWFFEFGFVIPNSTNTWQSLIEAAPESQMMPASVLTGNVIIETKFFDDDLLVSTSRVRLFYV

SEQ ID NO: 62978 - protein, 93 aa, Homo sapiens
  Payload ID: 12564
  Gene Symbol: PDE6D
  Gene Name: phosphodiesterase 6D, cGMP-specific, rod, delta
  ENSP ID: ENSP00000387108
MSAKDERAREILRGFKLNWMNLRDAETGKILWQGTEDLSVPGVEHEARVPKKILKCKAVSRELNFSSTEQMEKFRLEQKVYFKGQCLEVGTLS

SEQ ID NO: 62979 - protein, 104 aa, Homo sapiens
  Payload ID: 12564
  Gene Symbol: PDE6D
  Gene Name: phosphodiesterase 6D, cGMP-specific, rod, delta
  ENSP ID: ENSP00000399098
MNLRDAETGKILWQGTEDLSVPGVEHEARVPKKILKCKAVSRELNFSSTEQMEKFRLEQKVYFKGQCLEEWFFEFGFVIPNSTNTWQSLIEAAPESQMMPASVL

SEQ ID NO: 62980 - protein, 87 aa, Homo sapiens
  Payload ID: 12565
  Gene Symbol: PDE6G
  Gene Name: phosphodiesterase 6G, cGMP-specific, rod, gamma
  Uniprot ID: P18545
  ENSP ID: ENSP00000328412
MNLEPPKAEFRSATRVAGGPVTPRKGPPKFKQRQTRQFKSKPPKKGVQGFGDDIPGMEGLGTDITVICPWEAFNHLELHELAQYGII

SEQ ID NO: 62981 - protein, 87 aa, Homo sapiens; identical to SEQ ID NO: 62980
  Payload ID: 12565
  Gene Symbol: PDE6G
  Gene Name: phosphodiesterase 6G, cGMP-specific, rod, gamma
  Uniprot ID: P18545
  ENSP ID: ENSP00000458167

SEQ ID NO: 62982 - protein, 137 aa, Homo sapiens
  Payload ID: 12565
  Gene Symbol: PDE6G
  Gene Name: phosphodiesterase 6G, cGMP-specific, rod, gamma
  ENSP ID: ENSP00000458567
MKQRDKGRGWHPAEGGPALTAQPPETRPALDRSRRESRSQGCRGVSVSLTMNLEPPKAEFRSATRVAGGPVTPRKGPPKFKQRQTRQFKSKPPKKGVQGFGDDIPGMEGLGTDITVICPWEAFNHLELHELAQYGII

SEQ ID NO: 62983 - protein, 70 aa, Homo sapiens
  Payload ID: 12565
  Gene Symbol: PDE6G
  Gene Name: phosphodiesterase 6G, cGMP-specific, rod, gamma
  ENSP ID: ENSP00000460962
DKGRGWHPAEGGPALTAQPPETRPALGLGTTSLEWKAWEQTSQSSALGRPSTTWSCTSWPNMASSSTRPC

SEQ ID NO: 62984 - protein, 87 aa, Homo sapiens; identical to SEQ ID NO: 62980
  Payload ID: 12565
  Gene Symbol: PDE6G
  Gene Name: phosphodiesterase 6G, cGMP-specific, rod, gamma
  Uniprot ID: P18545
  ENSP ID: ENSP00000461464

SEQ ID NO: 62985 - protein, 83 aa, Homo sapiens
  Payload ID: 12566
  Gene Symbol: PDE6H
  Gene Name: phosphodiesterase 6H, cGMP-specific, cone, gamma
  Uniprot ID: Q13956
  ENSP ID: ENSP00000266395
MSDNTTLPAPASNQGPTTPRKGPPKFKQRQTRQFKSKPPKKGVKGFGDDIPGMEGLGTDITVICPWEAFSHLELHELAQFGII

SEQ ID NO: 62986 - protein, 456 aa, Homo sapiens
  Payload ID: 12567
  Gene Symbol: PDE7A
  Gene Name: phosphodiesterase 7A
  Uniprot ID: Q13946
  ENSP ID: ENSP00000368730
MGITLIWCLALVLIKWITSKRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 62987 - protein, 424 aa, Homo sapiens
  Payload ID: 12567
  Gene Symbol: PDE7A
  Gene Name: phosphodiesterase 7A
  Uniprot ID: Q13946
  ENSP ID: ENSP00000379881
MEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGNYTYLDIAG

SEQ ID NO: 62988 - protein, 482 aa, Homo sapiens
  Payload ID: 12567
  Gene Symbol: PDE7A
  Gene Name: phosphodiesterase 7A
  Uniprot ID: Q13946
  ENSP ID: ENSP00000385632
MEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 62989 - protein, 85 aa, Homo sapiens
  Payload ID: 12567
  Gene Symbol: PDE7A
  Gene Name: phosphodiesterase 7A
  ENSP ID: ENSP00000430262
MGITLIWCLALVLIKWITSKRRGAISYDSSDQTALYIRMLGDVRVRSRAGFESERRGSHPYIDFRIFHSQSEIEVSVSARNIRRL

SEQ ID NO: 62990 - protein, 450 aa, Homo sapiens
  Payload ID: 12568
  Gene Symbol: PDE7B
  Gene Name: phosphodiesterase 7B
  Uniprot ID: Q9NP56
  ENSP ID: ENSP00000310661
MSCLMVERCGEILFENPDQNAKCVCMLGDIRLRGQTGVRAERRGSYPFIDFRLLNSTTYSGEIGTKKKVKRLLSFQRYFHASRLLRGIIPQAPLHLLDEDYLGQARHMLSKVGMWDFDIFLFDRLTNGNSLVTLLCHLFNTHGLIHHFKLDMVTLHRFLVMVQEDYHSQNPYHNAVHAADVTQAMHCYLKEPKLASFLTPLDIMLGLLAAAAHDVDHPGVNQPFLIKTNHHLANLYQNMSVLENHHWRSTIGMLRESRLLAHLPKEMTQDIEQQLGSLILATDINRQNEFLTRLKAHLHNKDLRLEDAQDRHFMLQIALKCADICNPCRIWEMSKQWSERVCEEFYRQGELEQKFELEISPLCNQQKDSIPSIQIGFMSYIVEPLFREWAHFTGNSTLSENMLGHLAHNKAQWKSLLPRQHRSRGSSGSGPDHDHAGQGTESEEQEGDSP

SEQ ID NO: 62991 - protein, 200 aa, Homo sapiens
  Payload ID: 12568
  Gene Symbol: PDE7B
  Gene Name: phosphodiesterase 7B
  ENSP ID: ENSP00000403732
  MOD_RES (1)..(1): Any amino acid
XHMLSKVGMWDFDIFLFDRLTNGNSLVTLLCHLFNTHGLIHHFKLDMVTLHRFLVMVQEDYHSQNPYHNAVHAADVTQAMHCYLKEPKLASFLTPLDIMLGLLAAAAHDVDHPGVNQPFLIKTNHHLANLYQVREPNLEPATVWSIALGPVLKPESCPWRKPCFRVLEVQRRMKHNLCPQKFVQTQMLKMSKIQANLIPV

SEQ ID NO: 62992 - protein, 502 aa, Homo sapiens
  Payload ID: 12568
  Gene Symbol: PDE7B
  Gene Name: phosphodiesterase 7B
  ENSP ID: ENSP00000482117
MPVLERYFHPAELGRRWTGPEGVLPSSPGSRPGCQQGPLPWDLPEMIRMVKLVWKSKSELQATKQRGILDNEDALRSFPGDIRLRGQTGVRAERRGSYPFIDFRLLNSTTYSGEIGTKKKVKRLLSFQRYFHASRLLRGIIPQAPLHLLDEDYLGQARHMLSKVGMWDFDIFLFDRLTNGNSLVTLLCHLFNTHGLIHHFKLDMVTLHRFLVMVQEDYHSQNPYHNAVHAADVTQAMHCYLKEPKLASFLTPLDIMLGLLAAAAHDVDHPGVNQPFLIKTNHHLANLYQNMSVLENHHWRSTIGMLRESRLLAHLPKEMTQDIEQQLGSLILATDINRQNEFLTRLKAHLHNKDLRLEDAQDRHFMLQIALKCADICNPCRIWEMSKQWSERVCEEFYRQGELEQKFELEISPLCNQQKDSIPSIQIGFMSYIVEPLFREWAHFTGNSTLSENMLGHLAHNKAQWKSLLPRQHRSRGSSGSGPDHDHAGQGTESEEQEGDSP

SEQ ID NO: 62993 - protein, 829 aa, Homo sapiens
  Payload ID: 12569
  Gene Symbol: PDE8A
  Gene Name: phosphodiesterase 8A
  Uniprot ID: O60658
  ENSP ID: ENSP00000311453
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 62994 - protein, 783 aa, Homo sapiens
  Payload ID: 12569
  Gene Symbol: PDE8A
  Gene Name: phosphodiesterase 8A
  Uniprot ID: O60658
  ENSP ID: ENSP00000340679
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 62995 - protein, 829 aa, Homo sapiens; identical to SEQ ID NO: 62993
  Payload ID: 12569
  Gene Symbol: PDE8A
  Gene Name: phosphodiesterase 8A
  Uniprot ID: O60658
  ENSP ID: ENSP00000378056

SEQ ID NO: 62996 - protein, 272 aa, Homo sapiens
  Payload ID: 12569
  Gene Symbol: PDE8A
  Gene Name: phosphodiesterase 8A
  ENSP ID: ENSP00000431976
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQPCCSSSWFGAVHIPSSAPVEVGVGLLPSWSLRRT

SEQ ID NO: 62997 - protein, 228 aa, Homo sapiens
  Payload ID: 12569
  Gene Symbol: PDE8A
  Gene Name: phosphodiesterase 8A
  Uniprot ID: O60658
  ENSP ID: ENSP00000432309
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLSMQILHLKQQWAISQVN

SEQ ID NO: 62998 - protein, 231 aa, Homo sapiens
  Payload ID: 12569
  Gene Symbol: PDE8A
  Gene Name: phosphodiesterase 8A
  ENSP ID: ENSP00000452907
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRSGKEFTMPKRKTEIIYNKM

SEQ ID NO: 62999 - protein, 757 aa, Homo sapiens
  Payload ID: 12569
  Gene Symbol: PDE8A
  Gene Name: phosphodiesterase 8A
  Uniprot ID: O60658
  ENSP ID: ENSP00000453808
MRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 63000 - protein, 126 aa, Homo sapiens
  Payload ID: 12569
  Gene Symbol: PDE8A
  Gene Name: phosphodiesterase 8A
  ENSP ID: ENSP00000454094
AAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRGM

SEQ ID NO: 63001 - protein, 885 aa, Homo sapiens
  Payload ID: 12570
  Gene Symbol: PDE8B
  Gene Name: phosphodiesterase 8B
  Uniprot ID: O95263
  ENSP ID: ENSP00000264917
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 63002 - protein, 788 aa, Homo sapiens
  Payload ID: 12570
  Gene Symbol: PDE8B
  Gene Name: phosphodiesterase 8B
  Uniprot ID: O95263
  ENSP ID: ENSP00000330428
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 63003 - protein, 830 aa, Homo sapiens
  Payload ID: 12570
  Gene Symbol: PDE8B
  Gene Name: phosphodiesterase 8B
  Uniprot ID: O95263
  ENSP ID: ENSP00000331336
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 63004 - protein, 838 aa, Homo sapiens
  Payload ID: 12570
  Gene Symbol: PDE8B
  Gene Name: phosphodiesterase 8B
  Uniprot ID: O95263
  ENSP ID: ENSP00000345446
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 63005 - protein, 865 aa, Homo sapiens
  Payload ID: 12570
  Gene Symbol: PDE8B
  Gene Name: phosphodiesterase 8B
  Uniprot ID: O95263
  ENSP ID: ENSP00000345646
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 63006 - protein, 119 aa, Homo sapiens
  Payload ID: 12570
  Gene Symbol: PDE8B
  Gene Name: phosphodiesterase 8B
  ENSP ID: ENSP00000422861
MENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQ

SEQ ID NO: 63007 - protein, 350 aa, Homo sapiens
  Payload ID: 12570
  Gene Symbol: PDE8B
  Gene Name: phosphodiesterase 8B
  Uniprot ID: O95263
  ENSP ID: ENSP00000423461
MPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 63008 - protein, 116 aa, Homo sapiens
  Payload ID: 12570
  Gene Symbol: PDE8B
  Gene Name: phosphodiesterase 8B
  ENSP ID: ENSP00000425720
MRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRVCTR

SEQ ID NO: 63009 - protein, 112 aa, Homo sapiens
  Payload ID: 12570
  Gene Symbol: PDE8B
  Gene Name: phosphodiesterase 8B
  ENSP ID: ENSP00000426200
MRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNR

SEQ ID NO: 63010 - protein, 593 aa, Homo sapiens
  Payload ID: 12571
  Gene Symbol: PDE9A
  Gene Name: phosphodiesterase 9A
  Uniprot ID: O76083
  ENSP ID: ENSP00000291539
MGSGSSSYRPKAIYLDIDGRIQKVIFSKYCNSSDIMDLFCIATGLPRNTTISLLTTDDAMVSIDPTMPANSERTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63011 - protein, 567 aa, Homo sapiens
  Payload ID: 12571
  Gene Symbol: PDE9A
  Gene Name: phosphodiesterase 9A
  Uniprot ID: O76083
  ENSP ID: ENSP00000328699
MGSGSSSYRPKAIYLDIDGRIQKVIFSKYCNSSDIMDLFCIATGLPRTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63012 - protein, 533 aa, Homo sapiens
  Payload ID: 12571
  Gene Symbol: PDE9A
  Gene Name: phosphodiesterase 9A
  Uniprot ID: O76083
  ENSP ID: ENSP00000335242
MGSGSSSYRPKAIYLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63013 - protein, 491 aa, Homo sapiens
  Payload ID: 12571
  Gene Symbol: PDE9A
  Gene Name: phosphodiesterase 9A
  Uniprot ID: O76083
  ENSP ID: ENSP00000335365
MGSGSSSYRPKAIYLDIDGRIQKEHDHLPADHRRRHGLHRPHHAREFRTHSVQSETCGHQATLRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63014 - protein, 465 aa, Homo sapiens
  Payload ID: 12571
  Gene Symbol: PDE9A
  Gene Name: phosphodiesterase 9A
  Uniprot ID: O76083
  ENSP ID: ENSP00000344730
MGSGSSSYRPKAIYLDIDGRIQKHSVQSETCGHQATLRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63015 - protein, 540 aa, Homo sapiens
  Payload ID: 12571
  Gene Symbol: PDE9A
  Gene Name: phosphodiesterase 9A
  Uniprot ID: O76083
  ENSP ID: ENSP00000369685
MGSGSSSYRPKAIYLDIDGRIQKVIFSKYCNSSDIMDLFCIATGLPRNTTISLLTTDDAMVSIDPTMPANSERNELILYTSLRNLLFLPSKESWASHQHSVQSETCGHQATLRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63016 - protein, 466 aa, Homo sapiens
  Payload ID: 12571
  Gene Symbol: PDE9A
  Gene Name: phosphodiesterase 9A
  Uniprot ID: O76083
  ENSP ID: ENSP00000381280
MDAFRSTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63017 - protein, 552 aa, Homo sapiens
  Payload ID: 12571
  Gene Symbol: PDE9A
  Gene Name: phosphodiesterase 9A
  Uniprot ID: O76083
  ENSP ID: ENSP00000381281
MDAFRRNTTISLLTTDDAMVSIDPTMPANSERTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63018 - protein, 433 aa, Homo sapiens
  Payload ID: 12571
  Gene Symbol: PDE9A
  Gene Name: phosphodiesterase 9A
  Uniprot ID: O76083
  ENSP ID: ENSP00000381283
MDAFRRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63019 - protein, 459 aa, Homo sapiens
  Payload ID: 12571
  Gene Symbol: PDE9A
  Gene Name: phosphodiesterase 9A
  Uniprot ID: O76083
  ENSP ID: ENSP00000381285
MDAFRRNTTISLLTTDDAMVSIDPTMPANSERAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63020 - protein, 526 aa, Homo sapiens
  Payload ID: 12571
  Gene Symbol: PDE9A
  Gene Name: phosphodiesterase 9A
  Uniprot ID: O76083
  ENSP ID: ENSP00000381287
MDAFRSTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63021 - protein, 492 aa, Homo sapiens
  Payload ID: 12571
  Gene Symbol: PDE9A
  Gene Name: phosphodiesterase 9A
  Uniprot ID: O76083
  ENSP ID: ENSP00000381289
MDAFRRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63022 - protein, 507 aa, Homo sapiens
  Payload ID: 12571
  Gene Symbol: PDE9A
  Gene Name: phosphodiesterase 9A
  Uniprot ID: O76083
  ENSP ID: ENSP00000381291
MGSGSSSYRPKAIYLDIDGRIQKVIFSKYCNSSDIMDLFCIATGLPRTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 63023 - protein, 622 aa, Homo sapiens
  Payload ID: 12572
  Gene Symbol: PCK1
  Gene Name: phosphoenolpyruvate carboxykinase 1 (soluble)
  Uniprot ID: P35558
  ENSP ID: ENSP00000319814
MPPQLQNGLNLSAKVVQGSLDSLPQAVREFLENNAELCQPDHIHICDGSEEENGRLLGQMEEEGILRRLKKYDNCWLALTDPRDVARIESKTVIVTQEQRDTVPIPKTGLSQLGRWMSEEDFEKAFNARFPGCMKGRTMYVIPFSMGPLGSPLSKIGIELTDSPYVVASMRIMTRMGTPVLEAVGDGEFVKCLHSVGCPLPLQKPLVNNWPCNPELTLIAHLPDRREIISFGSGYGGNSLLGKKCFALRMASRLAKEEGWLAEHMLILGITNPEGEKKYLAAAFPSACGKTNLAMMNPSLPGWKVECVGDDIAWMKFDAQGHLRAINPENGFFGVAPGTSVKTNPNAIKTIQKNTIFTNVAETSDGGVYWEGIDEPLASGVTITSWKNKEWSSEDGEPCAHPNSRFCTPASQCPIIDAAWESPEGVPIEGIIFGGRRPAGVPLVYEALSWQHGVFVGAAMRSEATAAAEHKGKIIMHDPFAMRPFFGYNFGKYLAHWLSMAQHPAAKLPKIFHVNWFRKDKEGKFLWPGFGENSRVLEWMFNRIDGKASTKLTPIGYIPKEDALNLKGLGHINMMELFSISKEFWEKEVEDIEKYLEDQVNADLPCEIEREILALKQRISQM

SEQ ID NO: 63024 - protein, 640 aa, Homo sapiens
  Payload ID: 12573
  Gene Symbol: PCK2
  Gene Name: phosphoenolpyruvate carboxykinase 2 (mitochondrial)
  Uniprot ID: Q16822
  ENSP ID: ENSP00000216780
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 63025 - protein, 441 aa, Homo sapiens
  Payload ID: 12573
  Gene Symbol: PCK2
  Gene Name: phosphoenolpyruvate carboxykinase 2 (mitochondrial)
  ENSP ID: ENSP00000380171
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGMCGGEGVAQPPGLSTLMVEKLSPQPPTIF

SEQ ID NO: 63026 - protein, 506 aa, Homo sapiens
  Payload ID: 12573
  Gene Symbol: PCK2
  Gene Name: phosphoenolpyruvate carboxykinase 2 (mitochondrial)
  ENSP ID: ENSP00000441826
MSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 63027 - protein, 62 aa, Homo sapiens
  Payload ID: 12573
  Gene Symbol: PCK2
  Gene Name: phosphoenolpyruvate carboxykinase 2 (mitochondrial)
  ENSP ID: ENSP00000452748
MAALYRPGLRYLPRTSNGLSASAPGYFERQQGPGDKAFVPESEVTHICRTARSTWAALVGGL

SEQ ID NO: 63028 - protein, 509 aa, Homo sapiens
  Payload ID: 12573
  Gene Symbol: PCK2
  Gene Name: phosphoenolpyruvate carboxykinase 2 (mitochondrial)
  ENSP ID: ENSP00000453444
MGGGASKSGAEEWTQSSNGRDGLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGLLGTGGS

SEQ ID NO: 63029 - protein, 122 aa, Homo sapiens
  Payload ID: 12573
  Gene Symbol: PCK2
  Gene Name: phosphoenolpyruvate carboxykinase 2 (mitochondrial)
  ENSP ID: ENSP00000453528
  MOD_RES (1)..(1): Any amino acid
XVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLVRA

SEQ ID NO: 63030 - protein, 474 aa, Homo sapiens
  Payload ID: 12573
  Gene Symbol: PCK2
  Gene Name: phosphoenolpyruvate carboxykinase 2 (mitochondrial)
  ENSP ID: ENSP00000453656
MSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 63031 - protein, 107 aa, Homo sapiens
  Payload ID: 12573
  Gene Symbol: PCK2
  Gene Name: phosphoenolpyruvate carboxykinase 2 (mitochondrial)
  ENSP ID: ENSP00000453751
MSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVP

SEQ ID NO: 63032 - protein, 109 aa, Homo sapiens
  Payload ID: 12573
  Gene Symbol: PCK2
  Gene Name: phosphoenolpyruvate carboxykinase 2 (mitochondrial)
  ENSP ID: ENSP00000453791
  MOD_RES (1)..(1): Any amino acid
XIDQPLPPGVTVTSWLGKPWKPGDKEPCAHPNSRFCAPARQCPIMDPAWEAPEGVPIDAIIFGGRRPKEMGFRHIAQADLKFLWSSELPASASQSTGITGVSYHAYYTF

SEQ ID NO: 63033 - protein, 113 aa, Homo sapiens
  Payload ID: 12573
  Gene Symbol: PCK2
  Gene Name: phosphoenolpyruvate carboxykinase 2 (mitochondrial)
  ENSP ID: ENSP00000453998
MSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREII

SEQ ID NO: 63034 - protein, 506 aa, Homo sapiens; identical to SEQ ID NO: 63026
  Payload ID: 12573
  Gene Symbol: PCK2
  Gene Name: phosphoenolpyruvate carboxykinase 2 (mitochondrial)
  ENSP ID: ENSP00000454011

SEQ ID NO: 63035 - protein, 42 aa, Homo sapiens
  Payload ID: 12573
  Gene Symbol: PCK2
  Gene Name: phosphoenolpyruvate carboxykinase 2 (mitochondrial)
  ENSP ID: ENSP00000454020
MAALYRPGLRYLPRTSNGLSASAPGYFERQQGPGDKGLTGMG

SEQ ID NO: 63036 - protein, 780 aa, Homo sapiens
  Payload ID: 12574
  Gene Symbol: PFKL
  Gene Name: phosphofructokinase, liver
  Uniprot ID: P17858
  ENSP ID: ENSP00000269848
MAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 63037 - protein, 42 aa, Homo sapiens
  Payload ID: 12574
  Gene Symbol: PFKL
  Gene Name: phosphofructokinase, liver
  ENSP ID: ENSP00000381052
MAAVDLEKLRASGAGKAIGVLTSGGDAQGPLTSPPGPLLRWL

SEQ ID NO: 63038 - protein, 42 aa, Homo sapiens; identical to SEQ ID NO: 63037
  Payload ID: 12574
  Gene Symbol: PFKL
  Gene Name: phosphofructokinase, liver
  ENSP ID: ENSP00000486076

SEQ ID NO: 63039 - protein, 780 aa, Homo sapiens
  Payload ID: 12575
  Gene Symbol: PFKM
  Gene Name: phosphofructokinase, muscle
  Uniprot ID: P08237
  ENSP ID: ENSP00000309438
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNLVVKRLGYDTRVTVLGHVQRGGTPSAFDRILGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 63040 - protein, 851 aa, Homo sapiens
  Payload ID: 12575
  Gene Symbol: PFKM
  Gene Name: phosphofructokinase, muscle
  Uniprot ID: P08237
  ENSP ID: ENSP00000345771
MHKDEFHLKFFMCVIQSRQLVRTPQRTAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNLVVKRLGYDTRVTVLGHVQRGGTPSAFDRILGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 63041 - protein, 780 aa, Homo sapiens; identical to SEQ ID NO: 63039
  Payload ID: 12575
  Gene Symbol: PFKM
  Gene Name: phosphofructokinase, muscle
  Uniprot ID: P08237
  ENSP ID: ENSP00000352842

SEQ ID NO: 63042 - protein, 176 aa, Homo sapiens
  Payload ID: 12575
  Gene Symbol: PFKM
  Gene Name: phosphofructokinase, muscle
  ENSP ID: ENSP00000446519
MTHEEHHAAKTLGIGKAIAVLTSGGDAQGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAA

SEQ ID NO: 63043 - protein, 41 aa, Homo sapiens
  Payload ID: 12575
  Gene Symbol: PFKM
  Gene Name: phosphofructokinase, muscle
  ENSP ID: ENSP00000446740
  MOD_RES (1)..(1): Any amino acid
XSLSGNQAVRLPLMECVQVTKDVTKAMDEKKFDEALKLRGR

SEQ ID NO: 63044 - protein, 161 aa, Homo sapiens
  Payload ID: 12575
  Gene Symbol: PFKM
  Gene Name: phosphofructokinase, muscle
  ENSP ID: ENSP00000446805
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGL

SEQ ID NO: 63045 - protein, 152 aa, Homo sapiens
  Payload ID: 12575
  Gene Symbol: PFKM
  Gene Name: phosphofructokinase, muscle
  ENSP ID: ENSP00000446829
MRRGFRPGAERKTREPPRTGTAFTAPEESLEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGD

SEQ ID NO: 63046 - protein, 84 aa, Homo sapiens
  Payload ID: 12575
  Gene Symbol: PFKM
  Gene Name: phosphofructokinase, muscle
  ENSP ID: ENSP00000446945
MTHEEHHAAKTLGIGKAIAVLTSGGDAQGMNAAVRAVVRVGIFTGARVFFVHEGYQGLVDGGDHIKEATWESVSMMLQLGGTVI

SEQ ID NO: 63047 - protein, 59 aa, Homo sapiens
  Payload ID: 12575
  Gene Symbol: PFKM
  Gene Name: phosphofructokinase, muscle
  ENSP ID: ENSP00000447774
MTHEEHHAAKTLGIGKAIAVLTSGGDAQEDICVRSNGPPLWIPGPCHLSVLWGRLGFYS

SEQ ID NO: 63048 - protein, 176 aa, Homo sapiens
  Payload ID: 12575
  Gene Symbol: PFKM
  Gene Name: phosphofructokinase, muscle
  ENSP ID: ENSP00000447992
MHKDEFHLKFFMCVIQSRQLVRTPQRTAGEASTSSMLIPKPPPKTDILKSLDTMDDPDTVGSIPVFKTECAEVEIQVSKRKRAVVKARGDPTVETMKQREEWIMTHEEHHAAKTLGIGKAIAVLTSGGDAQEMGRDRPGAVAHTCNPRTLGGRGGQITRGWEFETSLTNMEKPRLY

SEQ ID NO: 63049 - protein, 149 aa, Homo sapiens
  Payload ID: 12575
  Gene Symbol: PFKM
  Gene Name: phosphofructokinase, muscle
  ENSP ID: ENSP00000447997
MRRGFRPGAERKTREPPRTGTAFTAPEESLAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATWESVSM

SEQ ID NO: 63050 - protein, 141 aa, Homo sapiens
  Payload ID: 12575
  Gene Symbol: PFKM
  Gene Name: phosphofructokinase, muscle
  ENSP ID: ENSP00000448018
MHKDEFHLKFFMCVIQSRQLVRTPQRTAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATW

SEQ ID NO: 63051 - protein, 749 aa, Homo sapiens
  Payload ID: 12575
  Gene Symbol: PFKM
  Gene Name: phosphofructokinase, muscle
  Uniprot ID: P08237
  ENSP ID: ENSP00000448177
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 63052 - protein, 139 aa, Homo sapiens
  Payload ID: 12575
  Gene Symbol: PFKM
  Gene Name: phosphofructokinase, muscle
  ENSP ID: ENSP00000448253
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDL

SEQ ID NO: 63053 - protein, 102 aa, Homo sapiens
  Payload ID: 12575
  Gene Symbol: PFKM
  Gene Name: phosphofructokinase, muscle
  ENSP ID: ENSP00000448315
MTHEEHHAAKTLGIGKAIAVLTSGGDAQGMNAAVRAVVRVGIFTGARVFFVHEGYQGLVDGGDHIKEATWESVSMMLQLLSSLKIHGQKFNMQCLVKALPRC

SEQ ID NO: 63054 - protein, 73 aa, Homo sapiens
  Payload ID: 12575
  Gene Symbol: PFKM
  Gene Name: phosphofructokinase, muscle
  ENSP ID: ENSP00000448318
MTHEEHHAAKTLGIGKAIAVLTSGGDAQEMGRDRPGAVAHTCNPRTLGGRGGQITRGWEFETSLTNMEKPRLY

SEQ ID NO: 63055 - protein, 149 aa, Homo sapiens
  Payload ID: 12575
  Gene Symbol: PFKM
  Gene Name: phosphofructokinase, muscle
  ENSP ID: ENSP00000448940
MHKDEFHLKFFMCVIQSRQLVRTPQRTAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATWESVSMMLQ

SEQ ID NO: 63056 - protein, 156 aa, Homo sapiens
  Payload ID: 12575
  Gene Symbol: PFKM
  Gene Name: phosphofructokinase, muscle
  ENSP ID: ENSP00000449269
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKADDDWEEHLCRRLSE

SEQ ID NO: 63057 - protein, 780 aa, Homo sapiens; identical to SEQ ID NO: 63039
  Payload ID: 12575
  Gene Symbol: PFKM
  Gene Name: phosphofructokinase, muscle
  Uniprot ID: P08237
  ENSP ID: ENSP00000449426

SEQ ID NO: 63058 - protein, 165 aa, Homo sapiens
  Payload ID: 12575
  Gene Symbol: PFKM
  Gene Name: phosphofructokinase, muscle
  ENSP ID: ENSP00000449622
MHKDEFHLKFFMCVIQSRQLVRTPQRTAGEASTSSMLIPKPPPKTDILKSLDTMDDPDTVGSIPVFKTECAEVEIQVSKRKRAVVKARGDPTVETMKQREEWIMTHEEHHAAKTLGIGKAIAVLTSGGDAQGMNAAVRAVVRVGIFTGARVFFVHEGYQGLVDGG

SEQ ID NO: 63059 - protein, 116 aa, Homo sapiens
  Payload ID: 12575
  Gene Symbol: PFKM
  Gene Name: phosphofructokinase, muscle
  ENSP ID: ENSP00000449835
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVI

SEQ ID NO: 63060 - protein, 97 aa, Homo sapiens
  Payload ID: 12575
  Gene Symbol: PFKM
  Gene Name: phosphofructokinase, muscle
  ENSP ID: ENSP00000450091
  MOD_RES (1)..(1): Any amino acid
XPFVVIPATVSNNVPGSDFSVGADTALNTICTANVEHLVQKMKTTVKRGLVLRNEKCNENYTTDFIFNLYSEEGKGIFDSRKNVLGHMQQGGSPTPF

SEQ ID NO: 63061 - protein, 125 aa, Homo sapiens
  Payload ID: 12575
  Gene Symbol: PFKM
  Gene Name: phosphofructokinase, muscle
  ENSP ID: ENSP00000450173
MHKDEFHLKFFMCVIQSRQLVRTPQRTAGEASTSSMLIPKPPPKTDILKSLDTMDDPDTVGSIPVFKTECAEVEIQVSKRKRAVVKARGDPTVETMKQREEWIMTHEEHHAAKTLGIGKAIAVLT

SEQ ID NO: 63062 - protein, 157 aa, Homo sapiens
  Payload ID: 12575
  Gene Symbol: PFKM
  Gene Name: phosphofructokinase, muscle
  ENSP ID: ENSP00000450369
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLN

SEQ ID NO: 63063 - protein, 102 aa, Homo sapiens; identical to SEQ ID NO: 63053
  Payload ID: 12575
  Gene Symbol: PFKM
  Gene Name: phosphofructokinase, muscle
  ENSP ID: ENSP00000486196

SEQ ID NO: 63064 - protein, 202 aa, Homo sapiens
  Payload ID: 12576
  Gene Symbol: PFKP
  Gene Name: phosphofructokinase, platelet
  ENSP ID: ENSP00000370462
MGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 63065 - protein, 776 aa, Homo sapiens
  Payload ID: 12576
  Gene Symbol: PFKP
  Gene Name: phosphofructokinase, platelet
  Uniprot ID: Q01813
  ENSP ID: ENSP00000370465
MCGYERCRPCRGAHGYLRGGQGVLHLRGLPGHGGRRLKHRRGRLGECLQHPASGAVRGDWREKPGCWSHRFPCPGRHALVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 63066 - protein, 784 aa, Homo sapiens
  Payload ID: 12576
  Gene Symbol: PFKP
  Gene Name: phosphofructokinase, platelet
  Uniprot ID: Q01813
  ENSP ID: ENSP00000370517
MDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 63067 - protein, 210 aa, Homo sapiens
  Payload ID: 12576
  Gene Symbol: PFKP
  Gene Name: phosphofructokinase, platelet
  ENSP ID: ENSP00000385880
MNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGW

SEQ ID NO: 63068 - protein, 166 aa, Homo sapiens
  Payload ID: 12576
  Gene Symbol: PFKP
  Gene Name: phosphofructokinase, platelet
  ENSP ID: ENSP00000387871
  MOD_RES (1)..(1): Any amino acid
XADGHRMLAIYDGFDGFAKGQIKEIGWTDVGGWTGQGGSILGTKRVLPGKYLEEIATQMRTHSINALLIIGGFEAYKSACDMAEARGRHQELCIPLCVVPATISNNVPGTEISLGSDTGLNAVVETCDRIKQSASGTKRRVFIIETMGGYCGYLANMGGLAAGADA

SEQ ID NO: 63069 - protein, 240 aa, Homo sapiens
  Payload ID: 12576
  Gene Symbol: PFKP
  Gene Name: phosphofructokinase, platelet
  ENSP ID: ENSP00000408858
MGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKG

SEQ ID NO: 63070 - protein, 103 aa, Homo sapiens
  Payload ID: 12576
  Gene Symbol: PFKP
  Gene Name: phosphofructokinase, platelet
  ENSP ID: ENSP00000410275
  MOD_RES (1)..(1): Any amino acid
XFIYQLYSEEGKGVFDCRKNVLGHMQQGGAPSPFDRNFGTKISARAMEWITAKLKEARGRGKKFTTDDSICVLGISKRNVIFQPVAELKKQTDFETVSMQPPR

SEQ ID NO: 63071 - protein, 118 aa, Homo sapiens
  Payload ID: 12576
  Gene Symbol: PFKP
  Gene Name: phosphofructokinase, platelet
  ENSP ID: ENSP00000476311
MGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALL

SEQ ID NO: 63072 - protein, 113 aa, Homo sapiens
  Payload ID: 12576
  Gene Symbol: PFKP
  Gene Name: phosphofructokinase, platelet
  ENSP ID: ENSP00000477128
MNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARN

SEQ ID NO: 63073 - protein, 963 aa, Homo sapiens
  Payload ID: 12577
  Gene Symbol: PACS1
  Gene Name: phosphofurin acidic cluster sorting protein 1
  Uniprot ID: Q6VY07
  ENSP ID: ENSP00000316454
MAERGGAGGGPGGAGGGSGQRGSGVAQSPQQPPPQQQQQQPPQQPTPPKLAQATSSSSSTSAAAASSSSSSTSTSMAVAVASGSAPPGGPGPGRTPAPVQMNLYATWEVDRSSSSCVPRLFSLTLKKLVMLKEMDKDLNSVVIAVKLQGSKRILRSNEIVLPASGLVETELQLTFSLQYPHFLKRDANKLQIMLQRRKRYKNRTILGYKTLAVGLINMAEVMQHPNEGALVLGLHSNVKDVSVPVAEIKIYSLSSQPIDHEGIKSKLSDRSPDIDNYSEEEEESFSSEQEGSDDPLHGQDLFYEDEDLRKVKKTRRKLTSTSAITRQPNIKQKFVALLKRFKVSDEVGFGLEHVSREQIREVEEDLDELYDSLEMYNPSDSGPEMEETESILSTPKPKLKPFFEGMSQSSSQTEIGSLNSKGSLGKDTTSPMELAALEKIKSTWIKNQDDSLTETDTLEITDQDMFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 63074 - protein, 107 aa, Homo sapiens
  Payload ID: 12577
  Gene Symbol: PACS1
  Gene Name: phosphofurin acidic cluster sorting protein 1
  ENSP ID: ENSP00000432365
  MOD_RES (1)..(1): Any amino acid
XDVIGLQVDYWLGHPGERRREGDKRDASSKNTLKSVFRSVQVSRLPHSGEAQLSGTMAMTVVTKEKNKKVSIDGVEWSDIKFFQLAAQWPTHVKHFPVGLFSGSKAT

SEQ ID NO: 63075 - protein, 166 aa, Homo sapiens
  Payload ID: 12577
  Gene Symbol: PACS1
  Gene Name: phosphofurin acidic cluster sorting protein 1
  ENSP ID: ENSP00000432639
MRTVAGTPVMAFPRGCLASSRLFSLTLKKLVMLKEMDKDLNSVVIAVKLQGSKRILRSNEIVLPASGLVETELQLTFSLQYPHFLKRDANKLQIMLQRRKRYKNRTILGYKTLAVGLINMAEVMQHPNEGALVLGLHSNVKDVSVPVAEIKIYSLSSQPIDHEGIK

SEQ ID NO: 63076 - protein, 499 aa, Homo sapiens
  Payload ID: 12577
  Gene Symbol: PACS1
  Gene Name: phosphofurin acidic cluster sorting protein 1
  ENSP ID: ENSP00000432858
MFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 63077 - protein, 91 aa, Homo sapiens
  Payload ID: 12577
  Gene Symbol: PACS1
  Gene Name: phosphofurin acidic cluster sorting protein 1
  ENSP ID: ENSP00000433991
MAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 63078 - protein, 76 aa, Homo sapiens
  Payload ID: 12577
  Gene Symbol: PACS1
  Gene Name: phosphofurin acidic cluster sorting protein 1
  ENSP ID: ENSP00000434012
MAMTVVTKEKNKKVPTIFLSKKPREKEVDSKSQVIEGISRLICSAKQQQTMLRVSIDGVEWSDIKFFQLAAQWPTH

SEQ ID NO: 63079 - protein, 89 aa, Homo sapiens
  Payload ID: 12577
  Gene Symbol: PACS1
  Gene Name: phosphofurin acidic cluster sorting protein 1
  ENSP ID: ENSP00000435037
YSEEEEESFSSEQEGSDDPLHGQDLFYEDEDLRKVKKTRRKLTSTSAITRCRASLGTKPLRAEMPTPSGMKRRPDHSPITMRCHWTSAT

SEQ ID NO: 63080 - protein, 79 aa, Homo sapiens
  Payload ID: 12577
  Gene Symbol: PACS1
  Gene Name: phosphofurin acidic cluster sorting protein 1
  ENSP ID: ENSP00000437052
MPRPVKVAAVGGQSYLSSILRFFVKSLANKTSDWLGYMRFLIIPLGSHPVAKYLGSVDSKYSSSFLDSGWRDLFSRSEP

SEQ ID NO: 63081 - protein, 106 aa, Homo sapiens
  Payload ID: 12577
  Gene Symbol: PACS1
  Gene Name: phosphofurin acidic cluster sorting protein 1
  ENSP ID: ENSP00000437150
MLHFLQIEDLWQPYVELFSLTLKKLVMLKEMDKDLNSVVIAVKLQGSKRILRSNEIVLPASGLVETELQLTFSLQYPHFLKRDANKLQIMLQRRKRYKNRTILGYK

SEQ ID NO: 63082 - protein, 118 aa, Homo sapiens
  Payload ID: 12577
  Gene Symbol: PACS1
  Gene Name: phosphofurin acidic cluster sorting protein 1
  ENSP ID: ENSP00000437274
  MOD_RES (1)..(1): Any amino acid
XIKIYSLSSQPIDHEGIKSKLSDRSPDIDNYSEEEEESFSSEQEGSDDPLHGQDLFYEDEDLRKVKKTRRKLTSTSAITRLHPRPRSYTGIWPVFLTGFECQGQRPSPPVFVSSHSSS

SEQ ID NO: 63083 - protein, 889 aa, Homo sapiens
  Payload ID: 12578
  Gene Symbol: PACS2
  Gene Name: phosphofurin acidic cluster sorting protein 2
  Uniprot ID: Q86VP3
  ENSP ID: ENSP00000321834
MAERGRLGLPGAPGALNTPVPMNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 63084 - protein, 814 aa, Homo sapiens
  Payload ID: 12578
  Gene Symbol: PACS2
  Gene Name: phosphofurin acidic cluster sorting protein 2
  Uniprot ID: Q86VP3
  ENSP ID: ENSP00000393524
MQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 63085 - protein, 904 aa, Homo sapiens
  Payload ID: 12578
  Gene Symbol: PACS2
  Gene Name: phosphofurin acidic cluster sorting protein 2
  Uniprot ID: Q86VP3
  ENSP ID: ENSP00000393559
MAERGRLGLPGAPGALNTPVPMNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQVQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKRKKHFHFDFTLSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 63086 - protein, 86 aa, Homo sapiens
  Payload ID: 12578
  Gene Symbol: PACS2
  Gene Name: phosphofurin acidic cluster sorting protein 2
  ENSP ID: ENSP00000447229
MQGSKRILRSHEIVLPPSGQVETDLALTFSLQYPHFLKREGNKLQIMLQRRKRYKNRTILGYKTLAAGSISMAEVMQHPSEGGQVL

SEQ ID NO: 63087 - protein, 859 aa, Homo sapiens
  Payload ID: 12578
  Gene Symbol: PACS2
  Gene Name: phosphofurin acidic cluster sorting protein 2
  ENSP ID: ENSP00000449525
MAERGRLGLPGAPGALNTPVPMNLFATWEVDGSSPSCVPRLCSLTLKKLVVFKELEKELISVVIAVKMQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 63088 - protein, 580 aa, Homo sapiens
  Payload ID: 12579
  Gene Symbol: PGM1
  Gene Name: phosphoglucomutase 1
  Uniprot ID: P36871
  ENSP ID: ENSP00000360124
MSDFEEWISGTYRKMEEGPLPLLTFATAPYHDQKPGTSGLRKKTYYFEEKPCYLENFIQSIFFSIDLKDRQGSSLVVGGDGRYFNKSAIETIVQMAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 63089 - protein, 562 aa, Homo sapiens
  Payload ID: 12579
  Gene Symbol: PGM1
  Gene Name: phosphoglucomutase 1
  Uniprot ID: P36871
  ENSP ID: ENSP00000360125
MVKIVTVKTQAYQDQKPGTSGLRKRVKVFQSSANYAENFIQSIISTVEPAQRQEATLVVGGDGRFYMKEAIQLIARIAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 63090 - protein, 365 aa, Homo sapiens
  Payload ID: 12579
  Gene Symbol: PGM1
  Gene Name: phosphoglucomutase 1
  Uniprot ID: P36871
  ENSP ID: ENSP00000443449
MLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 63091 - protein, 612 aa, Homo sapiens
  Payload ID: 12580
  Gene Symbol: PGM2
  Gene Name: phosphoglucomutase 2
  Uniprot ID: Q96G03
  ENSP ID: ENSP00000371393
MAAPEGSGLGEDARLDQETAQWLRWDKNSLTLEAVKRLIAEGNKEELRKCFGARMEFGTAGLRAAMGPGISRMNDLTIIQTTQGFCRYLEKQFSDLKQKGIVISFDARAHPSSGGSSRRFARLAATTFISQGIPVYLFSDITPTPFVPFTVSHLKLCAGIMITASHNPKQDNGYKVYWDNGAQIISPHDKGISQAIEENLEPWPQAWDDSLIDSSPLLHNPSASINNDYFEDLKKYCFHRSVNRETKVKFVHTSVHGVGHSFVQSAFKAFDLVPPEAVPEQKDPDPEFPTVKYPNPEEGKGVLTLSFALADKTKARIVLANDPDADRLAVAEKQDSGEWRVFSGNELGALLGWWLFTSWKEKNQDRSALKDTYMLSSTVSSKILRAIALKEGFHFEETLTGFKWMGNRAKQLIDQGKTVLFAFEEAIGYMCCPFVLDKDGVSAAVISAELASFLATKNLSLSQQLKAIYVEYGYHITKASYFICHDQETIKKLFENLRNYDGKNNYPKACGKFEISAIRDLTTGYDDSQPDKKAVLPTSKSSQMITFTFANGGVATMRTSGTEPKIKYYAELCAPPGNSDPEQLKKELNELVSAIEEHFFQPQKYNLQPKAD

SEQ ID NO: 63092 - protein, 59 aa, Homo sapiens
  Payload ID: 12580
  Gene Symbol: PGM2
  Gene Name: phosphoglucomutase 2
  ENSP ID: ENSP00000422785
YMLSSTVSSKILRAIALKEGFHFEETLTGFKWMGNRAKQLIDQGKTVLFAFEEAIGSSH

SEQ ID NO: 63093 - protein, 195 aa, Homo sapiens
  Payload ID: 12580
  Gene Symbol: PGM2
  Gene Name: phosphoglucomutase 2
  ENSP ID: ENSP00000423269
MAAPEGSGLGEDARLDQETAQWLRWDKNSLTLEAVKRLIAEGNKEELRKCFGARMEFGTAGLRAAMGPGISRMNDLTIIQTTQGFCRYLEKQFSDLKQKGIVISFDARAHPSSGGSSRRFARLAATTFISQGIPVYLFSDITPTPFVVEALKALEWRLRPSLCLKNFLALPSRRWNEKALRKLLTFLIRKYILEL

SEQ ID NO: 63094 - protein, 86 aa, Homo sapiens
  Payload ID: 12580
  Gene Symbol: PGM2
  Gene Name: phosphoglucomutase 2
  ENSP ID: ENSP00000425733
MAAPEGSGLGEDARLDQETAQWLRWDKNSLTLEAVKRLIAEGNKEELRKCFGARMEFGTAGLRAAMGPGISRMNDLTIIQTTQYHI

SEQ ID NO: 63095 - protein, 195 aa, Homo sapiens; identical to SEQ ID NO: 63093
  Payload ID: 12580
  Gene Symbol: PGM2
  Gene Name: phosphoglucomutase 2
  ENSP ID: ENSP00000426738

SEQ ID NO: 63096 - protein, 195 aa, Homo sapiens; identical to SEQ ID NO: 63093
  Payload ID: 12580
  Gene Symbol: PGM2
  Gene Name: phosphoglucomutase 2
  ENSP ID: ENSP00000485904

SEQ ID NO: 63097 - protein, 622 aa, Homo sapiens
  Payload ID: 12581
  Gene Symbol: PGM2L1
  Gene Name: phosphoglucomutase 2-like 1
  Uniprot ID: Q6PCE3
  ENSP ID: ENSP00000298198
MAENTEGDLNSNLLHAPYHTGDPQLDTAIGQWLRWDKNPKTKEQIENLLRNGMNKELRDRLCCRMTFGTAGLRSAMGAGFCYINDLTVIQSTQGMYKYLERCFSDFKQRGFVVGYDTRGQVTSSCSSQRLAKLTAAVLLAKDVPVYLFSRYVPTPFVPYAVQKLKAVAGVMITASHNRKEDNGYKVYWETGAQITSPHDKEILKCIEECVEPWNGSWNDNLVDTSPLKRDPLQDICRRYMEDLKKICFYRELNSKTTLKFVHTSFHGVGHDYVQLAFKVFGFKPPIPVPEQKDPDPDFSTVKCPNPEEGESVLELSLRLAEKENARVVLATDPDADRLAAAELQENGCWKVFTGNELAALFGWWMFDCWKKNKSRNADVKNVYMLATTVSSKILKAIALKEGFHFEETLPGFKWIGSRIIDLLENGKEVLFAFEESIGFLCGTSVLDKDGVSAAVVVAEMASYLETMNITLKQQLVKVYEKYGYHISKTSYFLCYEPPTIKSIFERLRNFDSPKEYPKFCGTFAILHVRDVTTGYDSSQPNKKSVLPVSKNSQMITFTFQNGCVATLRTSGTEPKIKYYAEMCASPDQSDTALLEEELKKLIDALIENFLQPSKNGLIWRSV

SEQ ID NO: 63098 - protein, 461 aa, Homo sapiens
  Payload ID: 12582
  Gene Symbol: PGM3
  Gene Name: phosphoglucomutase 3
  ENSP ID: ENSP00000283977
MLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGF

SEQ ID NO: 63099 - protein, 113 aa, Homo sapiens
  Payload ID: 12582
  Gene Symbol: PGM3
  Gene Name: phosphoglucomutase 3
  ENSP ID: ENSP00000421154
  MOD_RES (1)..(1): Any amino acid
XALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGF

SEQ ID NO: 63100 - protein, 566 aa, Homo sapiens
  Payload ID: 12582
  Gene Symbol: PGM3
  Gene Name: phosphoglucomutase 3
  Uniprot ID: O95394
  ENSP ID: ENSP00000421565
MDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGYKAAETTHNINNAFGPGTANEHTVP

SEQ ID NO: 63101 - protein, 114 aa, Homo sapiens
  Payload ID: 12582
  Gene Symbol: PGM3
  Gene Name: phosphoglucomutase 3
  ENSP ID: ENSP00000422362
MGGEWGQSAICPESAQEWTYQVGQHLVDMDLGAITKYSALHAKPNGLILQYGTAGFRTKAEHLDHVMFRMGLLAVLRSKQTKSTIGVMVTASHNPEEDNGVKLVDPLGEMLAPS

SEQ ID NO: 63102 - protein, 197 aa, Homo sapiens
  Payload ID: 12582
  Gene Symbol: PGM3
  Gene Name: phosphoglucomutase 3
  ENSP ID: ENSP00000423389
EANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQGSRLVVWIFIIWPLHILLKVCAKPGQSTVSALNRESGGDIWQLSCRSLSHLRV

SEQ ID NO: 63103 - protein, 71 aa, Homo sapiens
  Payload ID: 12582
  Gene Symbol: PGM3
  Gene Name: phosphoglucomutase 3
  ENSP ID: ENSP00000423769
MDLGAITKYSALHAKPNGLILQYGTAGFRTKAEHLDHVMFRMGLLAVLRSKQTKSTIGVMVTASHNPETMV

SEQ ID NO: 63104 - protein, 156 aa, Homo sapiens
  Payload ID: 12582
  Gene Symbol: PGM3
  Gene Name: phosphoglucomutase 3
  ENSP ID: ENSP00000424865
MGGEWGQSAICPESAQEWTYQVGQHLVDMDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRD

SEQ ID NO: 63105 - protein, 542 aa, Homo sapiens
  Payload ID: 12582
  Gene Symbol: PGM3
  Gene Name: phosphoglucomutase 3
  Uniprot ID: O95394
  ENSP ID: ENSP00000424874
MDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGF

SEQ ID NO: 63106 - protein, 146 aa, Homo sapiens
  Payload ID: 12582
  Gene Symbol: PGM3
  Gene Name: phosphoglucomutase 3
  ENSP ID: ENSP00000425558
MDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTRPSSEKLSQSVIDGVTV

SEQ ID NO: 63107 - protein, 570 aa, Homo sapiens
  Payload ID: 12582
  Gene Symbol: PGM3
  Gene Name: phosphoglucomutase 3
  Uniprot ID: O95394
  ENSP ID: ENSP00000425809
MGGEWGQSAICPESAQEWTYQVGQHLVDMDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGF

SEQ ID NO: 63108 - protein, 172 aa, Homo sapiens
  Payload ID: 12582
  Gene Symbol: PGM3
  Gene Name: phosphoglucomutase 3
  ENSP ID: ENSP00000427420
MLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADF

SEQ ID NO: 63109 - protein, 11 aa, Homo sapiens
  Payload ID: 12582
  Gene Symbol: PGM3
  Gene Name: phosphoglucomutase 3
  ENSP ID: ENSP00000474029
DAFVVIGRDTR

SEQ ID NO: 63110 - protein, 441 aa, Homo sapiens
  Payload ID: 12582
  Gene Symbol: PGM3
  Gene Name: phosphoglucomutase 3
  ENSP ID: ENSP00000477539
MLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQVRKCRSPCT

SEQ ID NO: 63111 - protein, 387 aa, Homo sapiens
  Payload ID: 12583
  Gene Symbol: PGM5
  Gene Name: phosphoglucomutase 5
  Uniprot ID: Q15124
  ENSP ID: ENSP00000379674
MEGSPIPVLTVPTAPYEDQRPAGGGGLRRPTGLFEGQRNYLPNFIQSVLSSIDLRDRQGCTMVVGSDGRYFSRTAIEIVVQMAAANGIGRLIIGQNGILSTPAVSCIIRKIKAAGGIILTASHCPGGPGGEFGVKFNVANGGPAPDVVSDKIYQISKTIEEYAICPDLRIDLSRLGRQEFDLENKFKPFRVEIVDPVDIYLNLLRTIFDFHAIKGLLTGPSQLKIRIDAMHGVMGPYVRKVLCDELGAPANSAINCVPLEDFGGQHPDPNLTYATTLLEAMKGGEYGFGAAFDADGDRYMILGQNGFFVSPSDSLAIIAANLSCIPYFRQMGVRGFGRSMPTSMALDRVAKSMKVPVYETPAGWRFFSNLMDSGRCNLCGEESFGTV

SEQ ID NO: 63112 - protein, 567 aa, Homo sapiens
  Payload ID: 12583
  Gene Symbol: PGM5
  Gene Name: phosphoglucomutase 5
  Uniprot ID: Q15124
  ENSP ID: ENSP00000379678
MEGSPIPVLTVPTAPYEDQRPAGGGGLRRPTGLFEGQRNYLPNFIQSVLSSIDLRDRQGCTMVVGSDGRYFSRTAIEIVVQMAAANGIGRLIIGQNGILSTPAVSCIIRKIKAAGGIILTASHCPGGPGGEFGVKFNVANGGPAPDVVSDKIYQISKTIEEYAICPDLRIDLSRLGRQEFDLENKFKPFRVEIVDPVDIYLNLLRTIFDFHAIKGLLTGPSQLKIRIDAMHGVMGPYVRKVLCDELGAPANSAINCVPLEDFGGQHPDPNLTYATTLLEAMKGGEYGFGAAFDADGDRYMILGQNGFFVSPSDSLAIIAANLSCIPYFRQMGVRGFGRSMPTSMALDRVAKSMKVPVYETPAGWRFFSNLMDSGRCNLCGEESFGTGSDHLREKDGLWAVLVWLSIIAARKQSVEEIVRDHWAKFGRHYYCRFDYEGLDPKTTYYIMRDLEALVTDKSFIGQQFAVGSHVYSVAKTDSFEYVDPVDGTVTKKQGLRIIFSDASRLIFRLSSSSGVRATLRLYAESYERDPSGHDQEPQAVLSPLIAIALKISQIHERTGRRGPTVIT

SEQ ID NO: 63113 - protein, 205 aa, Homo sapiens
  Payload ID: 12583
  Gene Symbol: PGM5
  Gene Name: phosphoglucomutase 5
  ENSP ID: ENSP00000394864
EGQRNYLPNFIQSVLSSIDLRDRQGCTMVVGSDGRYFSRTAIEIVVQMAAANGIGRLIIGQNGILSTPAVSCIIRKIKAAGGIILTASHCPGGPGGEFGVKFNVANGVEIVDPVDIYLNLLRTIFDFHAIKGLLTGPSQLKIRIDAMHGVMGPYVRKVLCDELGAPANSAINCVPLEDFGGQHPDPNLTYATTLLEAMKGGEYGF

SEQ ID NO: 63114 - protein, 483 aa, Homo sapiens
  Payload ID: 12584
  Gene Symbol: PGD
  Gene Name: phosphogluconate dehydrogenase
  Uniprot ID: P52209
  ENSP ID: ENSP00000270776
MAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 63115 - protein, 63 aa, Homo sapiens
  Payload ID: 12584
  Gene Symbol: PGD
  Gene Name: phosphogluconate dehydrogenase
  ENSP ID: ENSP00000465311
MAQADIALIGLAVMGQNLILNMNDHGFVDFCPSRSVLLIGLSPKLMISWPMRQREPKWWVPSP

SEQ ID NO: 63116 - protein, 224 aa, Homo sapiens
  Payload ID: 12584
  Gene Symbol: PGD
  Gene Name: phosphogluconate dehydrogenase
  ENSP ID: ENSP00000466156
MAQADIALIGLAVMGQNLILNMNDHGFVVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIR

SEQ ID NO: 63117 - protein, 205 aa, Homo sapiens
  Payload ID: 12584
  Gene Symbol: PGD
  Gene Name: phosphogluconate dehydrogenase
  ENSP ID: ENSP00000466358
MGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQ

SEQ ID NO: 63118 - protein, 160 aa, Homo sapiens
  Payload ID: 12584
  Gene Symbol: PGD
  Gene Name: phosphogluconate dehydrogenase
  ENSP ID: ENSP00000466574
MGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDW

SEQ ID NO: 63119 - protein, 256 aa, Homo sapiens
  Payload ID: 12584
  Gene Symbol: PGD
  Gene Name: phosphogluconate dehydrogenase
  ENSP ID: ENSP00000467362
  MOD_RES (1)..(1): Any amino acid
XDIALIGLAVMGQNLILNMNDHGFVVCAFNRTVSKVDDFLANEAKGTKVVGAQSLKEMVSKLKKPRRIILLVKAGQAVDDFIEKLRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLI

SEQ ID NO: 63120 - protein, 499 aa, Homo sapiens
  Payload ID: 12585
  Gene Symbol: PHGDH
  Gene Name: phosphoglycerate dehydrogenase
  ENSP ID: ENSP00000358415
MTFWTQMFFLLQDCEGLIVRSATKVTADVINAAEKLQVVGRAGTGVDNVDLEAATRKGILVMNTPNGNSLSAAELTCGMIMCLARQIPQATASMKDGKWERKKFMGTELNGKTLGILGLGRIGREVATRMQSFGMKTIGYDPIISPEVSASFGVQQLPLEEIWPLCDFITVHTPLLPSTTGLLNDNTFAQCKKGVRVVNCARGGIVDEGALLRALQSGQCAGAALDVFTEEPPRDRALVDHENVISCPHLGASTKEAQSRCGEEIAVQFVDMVKGKSLTGVVNAQALTSAFSPHTKPWIGLAEALGTLMRAWAGSPKGTIQVITQGTSLKNAGNCLSPAVIVGLLKEASKQADVNLVNAKLLVKEAGLNVTTSHSPAAPGEQGFGECLLAVALAGAPYQAVGLVQGTTPVLQGLNGAVFRPEVPLRRDLPLLLFRTQTSDPAMLPTMIGLLAEAGVRLLSYQTSLVSDGETWHVMGISSLLPSLEAWKQHVTEAFQFHF

SEQ ID NO: 63121 - protein, 533 aa, Homo sapiens
  Payload ID: 12585
  Gene Symbol: PHGDH
  Gene Name: phosphoglycerate dehydrogenase
  Uniprot ID: O43175
  ENSP ID: ENSP00000358417
MAFANLRKVLISDSLDPCCRKILQDGGLQVVEKQNLSKEELIAELQDCEGLIVRSATKVTADVINAAEKLQVVGRAGTGVDNVDLEAATRKGILVMNTPNGNSLSAAELTCGMIMCLARQIPQATASMKDGKWERKKFMGTELNGKTLGILGLGRIGREVATRMQSFGMKTIGYDPIISPEVSASFGVQQLPLEEIWPLCDFITVHTPLLPSTTGLLNDNTFAQCKKGVRVVNCARGGIVDEGALLRALQSGQCAGAALDVFTEEPPRDRALVDHENVISCPHLGASTKEAQSRCGEEIAVQFVDMVKGKSLTGVVNAQALTSAFSPHTKPWIGLAEALGTLMRAWAGSPKGTIQVITQGTSLKNAGNCLSPAVIVGLLKEASKQADVNLVNAKLLVKEAGLNVTTSHSPAAPGEQGFGECLLAVALAGAPYQAVGLVQGTTPVLQGLNGAVFRPEVPLRRDLPLLLFRTQTSDPAMLPTMIGLLAEAGVRLLSYQTSLVSDGETWHVMGISSLLPSLEAWKQHVTEAFQFHF

SEQ ID NO: 63122 - protein, 417 aa, Homo sapiens
  Payload ID: 12586
  Gene Symbol: PGK1
  Gene Name: phosphoglycerate kinase 1
  Uniprot ID: P00558
  ENSP ID: ENSP00000362413
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 63123 - protein, 417 aa, Homo sapiens
  Payload ID: 12587
  Gene Symbol: PGK2
  Gene Name: phosphoglycerate kinase 2
  Uniprot ID: P07205
  ENSP ID: ENSP00000305995
MSLSKKLTLDKLDVRGKRVIMRVDFNVPMKKNQITNNQRIKASIPSIKYCLDNGAKAVVLMSHLGRPDGVPMPDKYSLAPVAVELKSLLGKDVLFLKDCVGAEVEKACANPAPGSVILLENLRFHVEEEGKGQDPSGKKIKAEPDKIEAFRASLSKLGDVYVNDAFGTAHRAHSSMVGVNLPHKASGFLMKKELDYFAKALENPVRPFLAILGGAKVADKIQLIKNMLDKVNEMIIGGGMAYTFLKVLNNMEIGASLFDEEGAKIVKDIMAKAQKNGVRITFPVDFVTGDKFDENAQVGKATVASGISPGWMGLDCGPESNKNHAQVVAQARLIVWNGPLGVFEWDAFAKGTKALMDEIVKATSKGCITVIGGGDTATCCAKWNTEDKVSHVSTGGGASLELLEGKILPGVEALSNM

SEQ ID NO: 63124 - protein, 254 aa, Homo sapiens
  Payload ID: 12588
  Gene Symbol: PGAM1
  Gene Name: phosphoglycerate mutase 1 (brain)
  Uniprot ID: P18669
  ENSP ID: ENSP00000359991
MAAYKLVLIRHGESAWNLENRFSGWYDADLSPAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRKAMEAVAAQGKAKK

SEQ ID NO: 63125 - protein, 253 aa, Homo sapiens
  Payload ID: 12589
  Gene Symbol: PGAM2
  Gene Name: phosphoglycerate mutase 2 (muscle)
  Uniprot ID: P15259
  ENSP ID: ENSP00000297283
MATHRLVMVRHGESTWNQENRFCGWFDAELSEKGTEEAKRGAKAIKDAKMEFDICYTSVLKRAIRTLWAILDGTDQMWLPVVRTWRLNERHYGGLTGLNKAETAAKHGEEQVKIWRRSFDIPPPPMDEKHPYYNSISKERRYAGLKPGELPTCESLKDTIARALPFWNEEIVPQIKAGKRVLIAAHGNSLRGIVKHLEGMSDQAIMELNLPTGIPIVYELNKELKPTKPMQFLGDEETVRKAMEAVAAQGKAK

SEQ ID NO: 63126 - protein, 254 aa, Homo sapiens
  Payload ID: 12590
  Gene Symbol: PGAM4
  Gene Name: phosphoglycerate mutase family member 4
  Uniprot ID: Q8N0Y7
  ENSP ID: ENSP00000412189
MAAYKLVLIRHGESTWNLENRFSCWYDADLSPAGHEEAKRGGQALRDAGYEFDICLTSVQKRVIRTLWTVLDAIDQMWLPVVRTWRLNERHYGGLTGLNKAETAAKHGEAQVKIWRRSYDVPPPPMEPDHPFYSNISKDRRYADLTEDQLPSYESPKDTIARALPFWNEEIVPQIKEGKRVLIAAHGNSLQGIAKHVEGLSEEAIMELNLPTGIPIVYELDKNLKPIKPMQFLGDEETVCKAIEAVAAQGKAKK

SEQ ID NO: 63127 - protein, 321 aa, Homo sapiens
  Payload ID: 12591
  Gene Symbol: PGP
  Gene Name: phosphoglycolate phosphatase
  Uniprot ID: A6NDG6
  ENSP ID: ENSP00000330918
MAAAEAGGDDARCVRLSAERAQALLADVDTLLFDCDGVLWRGETAVPGAPEALRALRARGKRLGFITNNSSKTRAAYAEKLRRLGFGGPAGPGASLEVFGTAYCTALYLRQRLAGAPAPKAYVLGSPALAAELEAVGVASVGVGPEPLQGEGPGDWLHAPLEPDVRAVVVGFDPHFSYMKLTKALRYLQQPGCLLVGTNMDNRLPLENGRFIAGTGCLVRAVEMAAQRQADIIGKPSRFIFDCVSQEYGINPERTVMVGDRLDTDILLGATCGLKTILTLTGVSTLGDVKNNQESDCVSKKKMVPDFYVDSIADLLPALQG

SEQ ID NO: 63128 - protein, 57 aa, Homo sapiens
  Payload ID: 12591
  Gene Symbol: PGP
  Gene Name: phosphoglycolate phosphatase
  ENSP ID: ENSP00000457909
  MOD_RES (1)..(1): Any amino acid
XILLGATCGLKTILTLTGVSTLGDVKNNQESDCVSKKKMVPDFYVDSIADLLPALQG

SEQ ID NO: 63129 - protein, 125 aa, Homo sapiens
  Payload ID: 12592
  Gene Symbol: PHPT1
  Gene Name: phosphohistidine phosphatase 1
  Uniprot ID: Q9NRX4
  ENSP ID: ENSP00000247665
MAVADLALIPDVDIDSDGVFKYVLIRVHSAPRSGAPAAESKEIVRGYKWAEYHADIYDKVSGDMQKQGCDCECLGGGRISHQSQDKKIHVYGYSMAYGPAQHAISTEKIKAKYPDYEVTWANDGY

SEQ ID NO: 63130 - protein, 124 aa, Homo sapiens
  Payload ID: 12592
  Gene Symbol: PHPT1
  Gene Name: phosphohistidine phosphatase 1
  Uniprot ID: Q9NRX4
  ENSP ID: ENSP00000360724
MAVADLALIPDVDIDSDGVFKYVLIRVHSAPRSGAPAAESKEIVRGYKWAEYHADIYDKVSGDMQKQGCDCECLGGGRISHQSQDKKIHVYGYSMMRPTCVPLGASGPRIHHQGLWSCPARHFN

SEQ ID NO: 63131 - protein, 2098 aa, Homo sapiens
  Payload ID: 12593
  Gene Symbol: PIKFYVE
  Gene Name: phosphoinositide kinase, FYVE finger containing
  Uniprot ID: Q9Y2I7
  ENSP ID: ENSP00000264380
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALDTRRKAEPTFGGHDPRTAVQLRSLSTVLKRLKEIMEGKSQDSDLKQYWMPDSQCKECYDCSEKFTTFRRRHHCRLCGQIFCSRCCNQEIPGKFMGYTGDLRACTYCRKIALSYAHSTDSNSIGEDLNALSDSACSVSVLDPSEPRTPVGSRKASRNIFLEDDLAWQSLIHPDSSNTPLSTRLVSVQEDAGKSPARNRSASITNLSLDRSGSPMVPSYETSVSPQANRTYVRTETTEDERKILLDSVQLKDLWKKICHHSSGMEFQDHRYWLRTHPNCIVGKELVNWLIRNGHIATRAQAIAIGQAMVDGRWLDCVSHHDQLFRDEYALYRPLQSTEFSETPSPDSDSVNSVEGHSEPSWFKDIKFDDSDTEQIAEEGDDNLANSASPSKRTSVSSFQSTVDSDSAASISLNVELDNVNFHIKKPSKYPHVPPHPADQKEYLISDTGGQQLSISDAFIKESLFNRRVEEKSKELPFTPLGWHHNNLELLREENGEKQAMERLLSANHNHMMALLQQLLHSDSLSSSWRDIIVSLVCQVVQTVRPDVKNQDDDMDIRQFVHIKKIPGGKKFDSVVVNGFVCTKNIAHKKMSSCIKNPKILLLKCSIEYLYREETKFTCIDPIVLQEREFLKNYVQRIVDVRPTLVLVEKTVSRIAQDMLLEHGITLVINVKSQVLERISRMTQGDLVMSMDQLLTKPHLGTCHKFYMQIFQLPNEQTKTLMFFEGCPQHLGCTIKLRGGSDYELARVKEILIFMICVAYHSQLEISFLMDEFAMPPTLMQNPSFHSLIEGRGHEGAVQEQYGGGSIPWDPDIPPESLPCDDSSLLELRIVFEKGEQENKNLPQAVASVKHQEHSTTACPAGLPCAFFAPVPESLLPLPVDDQQDALGSEQPETLQQTVVLQDPKSQIRAFRDPLQDDTGLYVTEEVTSSEDKRKTYSLAFKQELKDVILCISPVITFREPFLLTEKGMRCSTRDYFAEQVYWSPLLNKEFKEMENRRKKQLLRDLSGLQGMNGSIQAKSIQVLPSHELVSTRIAEHLGDSQSLGRMLADYRARGGRIQPKNSDPFAHSKDASSTSSGQSGSKNEGDEERGLILSDAVWSTKVDCLNPINHQRLCVLFSSSSAQSSNAPSACVSPWIVTMEFYGKNDLTLGIFLERYCFRPSYQCPSMFCDTPMVHHIRRFVHGQGCVQIILKELDSPVPGYQHTILTYSWCRICKQVTPVVALSNESWSMSFAKYLELRFYGHQYTRRANAEPCGHSIHHDYHQYFSYNQMVASFSYSPIRLLEVCVPLPKIFIKRQAPLKVSLLQDLKDFFQKVSQVYVAIDERLASLKTDTFSKTREEKMEDIFAQKEMEEGEFKNWIEKMQARLMSSSVDTPQQLQSVFESLIAKKQSLCEVLQAWNNRLQDLFQQEKGRKRPSVPPSPGRLRQGEESKISAMDASPRNISPGLQNGEKEDRFLTTLSSQSSTSSTHLQLPTPPEVMSEQSVGGPPELDTASSSEDVFDGHLLGSTDSQVKEKSTMKAIFANLLPGNSYNPIPFPFDPDKHYLMYEHERVPIAVCEKEPSSIIAFALSCKEYRNALEELSKATQWNSAEEGLPTNSTSDSRPKSSSPIRLPEMSGGQTNRTTETEPQPTKKASGMLSFFRGTAGKSPDLSSQKRETLRGADSAYYQVGQTGKEGTENQGVEPQDEVDGGDTQKKQLINPHVELQFSDANAKFYCRLYYAGEFHKMREVILDSSEEDFIRSLSHSSPWQARGGKSGAAFYATEDDRFILKQMPRLEVQSFLDFAPHYFNYITNAVQQKRPTALAKILGVYRIGYKNSQNNTEKKLDLLVMENLFYGRKMAQVFDLKGSLRNRNVKTDTGKESCDVVLLDENLLKMVRDNPLYIRSHSKAVLRTSIHSDSHFLSSHLIIDYSLLVGRDDTSNELVVGIIDYIRTFTWDKKLEMVVKSTGILGGQGKMPTVVSPELYRTRFCEAMDKYFLMVPDHWTGLGLNC

SEQ ID NO: 63132 - protein, 462 aa, Homo sapiens
  Payload ID: 12593
  Gene Symbol: PIKFYVE
  Gene Name: phosphoinositide kinase, FYVE finger containing
  Uniprot ID: Q9Y2I7
  ENSP ID: ENSP00000308715
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALDNSLQHPQENTGDLRACTYCRKIALSYAHSTDSNSIGEDLNALSDSACSVSVLDPSEPRTPVGSRKASRNIFLEDDLAWQSLIHPDSSNTPLSTRLVSVQEDAGKSPARNRSASITNLSLDRSGSPMVPSYETSVSPQANRTYVRTETTEDERKILLDSVQLKDLWKKICHHSSGMEFQDHRYWLRTHPNCIVGKELVNWLIRNGHIATRAQAIAIGQAMVDGRWLDCVSHHDQLFRDEYALYRPLQSTEFSETPSPDSDSVNSVEGHSEPSWFKDIKFDDSDTEQIAEEGDDNLANSASPSKRTSVSSFQSTVDSDSAASISLNVELDNVNFHIKKPSKYPHVPPHPADQKGRR

SEQ ID NO: 63133 - protein, 451 aa, Homo sapiens
  Payload ID: 12593
  Gene Symbol: PIKFYVE
  Gene Name: phosphoinositide kinase, FYVE finger containing
  Uniprot ID: Q9Y2I7
  ENSP ID: ENSP00000376038
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALGDLRACTYCRKIALSYAHSTDSNSIGEDLNALSDSACSVSVLDPSEPRTPVGSRKASRNIFLEDDLAWQSLIHPDSSNTPLSTRLVSVQEDAGKSPARNRSASITNLSLDRSGSPMVPSYETSVSPQANRTYVRTETTEDERKILLDSVQLKDLWKKICHHSSGMEFQDHRYWLRTHPNCIVGKELVNWLIRNGHIATRAQAIAIGQAMVDGRWLDCVSHHDQLFRDEYALYRPLQSTEFSETPSPDSDSVNSVEGHSEPSWFKDIKFDDSDTEQIAEEGDDNLANSASPSKRTSVSSFQSTVDSDSAASISLNVELDNVNFHIKKPSKYPHVPPHPADQKGRR

SEQ ID NO: 63134 - protein, 548 aa, Homo sapiens
  Payload ID: 12593
  Gene Symbol: PIKFYVE
  Gene Name: phosphoinositide kinase, FYVE finger containing
  Uniprot ID: Q9Y2I7
  ENSP ID: ENSP00000384356
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALDTRRKAEPTFGGHDPRTAVQLRSLSTVLKRLKEIMEGKSQDSDLKQYWMPDSQCKECYDCSEKFTTFRRRHHCRLCGQIFCSRCCNQEIPGKFMGYTGDLRACTYCRKIALSYAHSTDSNSIGEDLNALSDSACSVSVLDPSEPRTPVGSRKASRNIFLEDDLAWQSLIHPDSSNTPLSTRLVSVQEDAGKSPARNRSASITNLSLDRSGSPMVPSYETSVSPQANRTYVRTETTEDERKILLDSVQLKDLWKKICHHSSGMEFQDHRYWLRTHPNCIVGKELVNWLIRNGHIATRAQAIAIGQAMVDGRWLDCVSHHDQLFRDEYALYRPLQSTEFSETPSPDSDSVNSVEGHSEPSWFKDIKFDDSDTEQIAEEGDDNLANSASPSKRTSVSSFQSTVDSDSAASISLNVELDNVNFHIKKPSKYPHVPPHPADQKGRR

SEQ ID NO: 63135 - protein, 1384 aa, Homo sapiens
  Payload ID: 12593
  Gene Symbol: PIKFYVE
  Gene Name: phosphoinositide kinase, FYVE finger containing
  ENSP ID: ENSP00000405736
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALDTRRKAEPTFGGHDPRTAVQLRSLSTVLKRLKEIMEGKSQDSDLKQYWMPDSQCKECYDCSEKFTTFRRRHHCRLCGQIFCSRCCNQEIPGKFMGYTGDLRACTYCRKIALSYAHSTDSNSIGEDLNALSDSACSVSVLDPSEPRTPVGSRKASRNIFLEDDLAWQSLIHPDSSNTPLSTRLVSVQEDAGKSPARNRSASITNLSLDRSGSPMVPSYETSVSPQANRTYVRTETTEDERKILLDSVQLKDLWKKICHHSSGMEFQDHRYWLRTHPNCIVGKELVNWLIRNGHIATRAQAIAIGQAMVDGRWLDCVSHHDQLFRDEYALYRPLQSTEFSETPSPDSDSVNSVEGHSEPSWFKDIKFDDSDTEQIAEEGDDNLAKYLISDTGGQQLSISDAFIKESLFNRRVEEKSKELPFTPLGWHHNNLELLREENGEKQAMERLLSANHNHMMALLQQLLHSDSLSSSWRDIIVSLVCQVVQTVRPDVKNQDDDMDIRQFVHIKKIPGGKKFDSVVVNGFVCTKNIAHKKMSSCIKNPKILLLKCSIEYLYREETKFTCIDPIVLQEREFLKNYVQRIVDVRPTLVLVEKTVSRIAQDMLLEHGITLVINVKSQVLERISRMTQGDLVMSMDQLLTKPHLGTCHKFYMQIFQLPNEQTKTLMFFEGCPQHLGCTIKLRGGSDYELARVKEILIFMICVAYHSQLEISFLMDEFAMPPTLMQNPSFHSLIEGRGHEGAVQEQYGGGSIPWDPDIPPESLPCDDSSLLELRIVFEKGEQENKNLPQAVASVKHQEHSTTACPAGLPCAFFAPVPESLLPLPVDDQQDALGSEQPETLQQTVVLQDPKSQIRAFRDPLQDDTGLYVTEEVTSSEDKRKTYSLAFKQELKDVILCISPVITFREPFLLTEKGMRCSTRDYFAEQVYWSPLLNKEFKEMENRRKKQLLRDLSGLQGMNGSIQAKSIQVLPSHELVSTRIAEHLGDSQSLGRMLADYRARGGRIQPKNSDPFAHSKDASSTSSGQSGSKNEGDEERGLILSDAVWSTKVDCLNPINHQRLCVLFSSSSAQSSNAPSACVSPWIVTMEFYGKNDLTLGIFLERYCFRPSYQCPSMFCDTPMVHHIRRFVHGQGCVQIILKELDSPVPGYQHTILTYSWCRICKQVTPVVALSNESWSMSFAKYLELRFYGHQYTRRANAEPCGHSIHHDYHQYFSYNQMVASFSYSPIRLLEVCVPLPKIFIKRQAPLKVSLLQDLKDFFQKVSQVYVAIDERLASLKTDTFS

SEQ ID NO: 63136 - protein, 158 aa, Homo sapiens
  Payload ID: 12593
  Gene Symbol: PIKFYVE
  Gene Name: phosphoinositide kinase, FYVE finger containing
  ENSP ID: ENSP00000407692
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALDTRRKAEPTFGGHDPRTAVQLRSLSTVLKRLKEIMEGKSQETSELAHIVEK

SEQ ID NO: 63137 - protein, 241 aa, Homo sapiens
  Payload ID: 12593
  Gene Symbol: PIKFYVE
  Gene Name: phosphoinositide kinase, FYVE finger containing
  ENSP ID: ENSP00000414477
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALADNSLQHPQENTDTRRKAEPTFGGHDPRTAVQLRSLSTVLKRLKEIMEGKSQDSDLKQYWMPDSQCKECYDCSEKFTTFRRRHHCRLCGQIFCSRCCNQEIPGKFMGYTGDLRACTYCRKIALSYAHSTDSNSI

SEQ ID NO: 63138 - protein, 805 aa, Homo sapiens
  Payload ID: 12594
  Gene Symbol: PIK3AP1
  Gene Name: phosphoinositide-3-kinase adaptor protein 1
  Uniprot ID: Q6ZUJ8
  ENSP ID: ENSP00000339826
MAASGVPRGCDILIVYSPDAEEWCQYLQTLFLSSRQVRSQKILTHRLGPEASFSAEDLSLFLSTRCVVVLLSAELVQHFHKPALLPLLQRAFHPPHRVVRLLCGVRDSEEFLDFFPDWAHWQELTCDDEPETYVAAVKKAISEDSGCDSVTDTEPEDEKVVSYSKQQNLPTVTSPGNLMVVQPDRIRCGAETTVYVIVRCKLDDRVATEAEFSPEDSPSVRMEAKVENEYTISVKAPNLSSGNVSLKIYSGDLVVCETVISYYTDMEEIGNLLSNAANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAAFVPAATEDLYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 63139 - protein, 404 aa, Homo sapiens
  Payload ID: 12594
  Gene Symbol: PIK3AP1
  Gene Name: phosphoinositide-3-kinase adaptor protein 1
  Uniprot ID: Q6ZUJ8
  ENSP ID: ENSP00000360150
MRFFTSVACYGSCLFASELLIRCKDWLKGRPALFTALLACVLYLCEWTGAKHVPGSSYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 63140 - protein, 627 aa, Homo sapiens
  Payload ID: 12594
  Gene Symbol: PIK3AP1
  Gene Name: phosphoinositide-3-kinase adaptor protein 1
  Uniprot ID: Q6ZUJ8
  ENSP ID: ENSP00000360151
MVVQPDRIRCGAETTVYVIVRCKLDDRVATEAEFSPEDSPSVRMEAKVENEYTISVKAPNLSSGNVSLKIYSGDLVVCETVISYYTDMEEIGNLLSNAANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAAFVPAATEDLYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 63141 - protein, 263 aa, Homo sapiens
  Payload ID: 12595
  Gene Symbol: PIK3IP1
  Gene Name: phosphoinositide-3-kinase interacting protein 1
  Uniprot ID: Q96FE7
  ENSP ID: ENSP00000215912
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRGKDLKEQHDQKVCEREMQRITLPLSAFTNPTCEIVDEKTVVVHTSQTPVDPQEGTTPLMGQAGTPGA

SEQ ID NO: 63142 - protein, 234 aa, Homo sapiens
  Payload ID: 12595
  Gene Symbol: PIK3IP1
  Gene Name: phosphoinositide-3-kinase interacting protein 1
  Uniprot ID: Q96FE7
  ENSP ID: ENSP00000385204
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRSVASLLGPLRRRGGRYTKSNFVAFLPKRKQDVENQLKM

SEQ ID NO: 63143 - protein, 144 aa, Homo sapiens
  Payload ID: 12595
  Gene Symbol: PIK3IP1
  Gene Name: phosphoinositide-3-kinase interacting protein 1
  ENSP ID: ENSP00000414227
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPGQVQLWNSLRAVPDESCFPPHLQRPPPRPCQPSRQKSRKRLK

SEQ ID NO: 63144 - protein, 173 aa, Homo sapiens
  Payload ID: 12595
  Gene Symbol: PIK3IP1
  Gene Name: phosphoinositide-3-kinase interacting protein 1
  Uniprot ID: Q96FE7
  ENSP ID: ENSP00000415608
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGGRI

SEQ ID NO: 63145 - protein, 424 aa, Homo sapiens
  Payload ID: 12596
  Gene Symbol: PIK3R1
  Gene Name: phosphoinositide-3-kinase, regulatory subunit 1 (alpha)
  Uniprot ID: P27986
  ENSP ID: ENSP00000323512
MHNLQTLPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 63146 - protein, 454 aa, Homo sapiens
  Payload ID: 12596
  Gene Symbol: PIK3R1
  Gene Name: phosphoinositide-3-kinase, regulatory subunit 1 (alpha)
  Uniprot ID: P27986
  ENSP ID: ENSP00000338554
MYNTVWNMEDLDLEYAKTDINCGTDLMFYIEMDPPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 63147 - protein, 724 aa, Homo sapiens
  Payload ID: 12596
  Gene Symbol: PIK3R1
  Gene Name: phosphoinositide-3-kinase, regulatory subunit 1 (alpha)
  Uniprot ID: P27986
  ENSP ID: ENSP00000428056
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 63148 - protein, 131 aa, Homo sapiens
  Payload ID: 12596
  Gene Symbol: PIK3R1
  Gene Name: phosphoinositide-3-kinase, regulatory subunit 1 (alpha)
  ENSP ID: ENSP00000428566
TAKEPHQNRRLERALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRS

SEQ ID NO: 63149 - protein, 189 aa, Homo sapiens
  Payload ID: 12596
  Gene Symbol: PIK3R1
  Gene Name: phosphoinositide-3-kinase, regulatory subunit 1 (alpha)
  ENSP ID: ENSP00000429156
KDDQKKSLSTGELEEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREG

SEQ ID NO: 63150 - protein, 724 aa, Homo sapiens; identical to SEQ ID NO: 63147
  Payload ID: 12596
  Gene Symbol: PIK3R1
  Gene Name: phosphoinositide-3-kinase, regulatory subunit 1 (alpha)
  Uniprot ID: P27986
  ENSP ID: ENSP00000429277

SEQ ID NO: 63151 - protein, 102 aa, Homo sapiens
  Payload ID: 12596
  Gene Symbol: PIK3R1
  Gene Name: phosphoinositide-3-kinase, regulatory subunit 1 (alpha)
  ENSP ID: ENSP00000429766
MLFRFSAASSDNTENLIKVIEILISTEWNERQPAPALPPKPPKPTTVANNGMNNNMSLQDAEWYWGDISREEVNEKLRDTADGTFLVRDASTKMHGDYTLTL

SEQ ID NO: 63152 - protein, 361 aa, Homo sapiens
  Payload ID: 12596
  Gene Symbol: PIK3R1
  Gene Name: phosphoinositide-3-kinase, regulatory subunit 1 (alpha)
  Uniprot ID: P27986
  ENSP ID: ENSP00000430098
MHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 63153 - protein, 117 aa, Homo sapiens
  Payload ID: 12596
  Gene Symbol: PIK3R1
  Gene Name: phosphoinositide-3-kinase, regulatory subunit 1 (alpha)
  ENSP ID: ENSP00000430126
MLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRD

SEQ ID NO: 63154 - protein, 38 aa, Homo sapiens
  Payload ID: 12596
  Gene Symbol: PIK3R1
  Gene Name: phosphoinositide-3-kinase, regulatory subunit 1 (alpha)
  ENSP ID: ENSP00000430424
MYNTVWNMEDLDLEYAKTDINCGTDLMFYIEMDPPGKK

SEQ ID NO: 63155 - protein, 137 aa, Homo sapiens
  Payload ID: 12596
  Gene Symbol: PIK3R1
  Gene Name: phosphoinositide-3-kinase, regulatory subunit 1 (alpha)
  ENSP ID: ENSP00000431058
MHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQT

SEQ ID NO: 63156 - protein, 728 aa, Homo sapiens; identical to SEQ ID NO: 62516
  Payload ID: 12597
  Gene Symbol: PIK3R2
  Gene Name: phosphoinositide-3-kinase, regulatory subunit 2 (beta)
  Uniprot ID: O00459
  ENSP ID: ENSP00000222254

SEQ ID NO: 63157 - protein, 481 aa, Homo sapiens
  Payload ID: 12597
  Gene Symbol: PIK3R2
  Gene Name: phosphoinositide-3-kinase, regulatory subunit 2 (beta)
  ENSP ID: ENSP00000395636
MAGPEGFQYRALYPFRRERPEDLELLPGDVLVVSRAALQALGVAEGGERCPQSVGWMPGLNERTRQRGDFPGTYVEFLGPVALARPGPRPRGPRPLPARPRDGAPEPGLTLPDLPEQFSPPDVAPPLLVKLVEAIERTGLDSESHYRPELPAPRTDWSLSDVDQWDTAALADGIKSFLLALPAPLVTPEASAEARRALREAAGPVGPALEPPTLPLHRALTLRFLLQHLGRVASRAPALGPAVRALGATFGPLLLRAPPPPSSPPPGGAPDGSEPSPDFPALLVEKLLQEHLEEQEVAPPALPPKPPKAKPASTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQGLLGSPRRC

SEQ ID NO: 63158 - protein, 124 aa, Homo sapiens
  Payload ID: 12597
  Gene Symbol: PIK3R2
  Gene Name: phosphoinositide-3-kinase, regulatory subunit 2 (beta)
  ENSP ID: ENSP00000476825
  MOD_RES (1)..(1): Any amino acid
XEGNEKEMQRILLNSERLKSRIAEIHESRTKLEQQLRAQASDNREIDKRMNSLKPDLMQLRKIRDQYLVWLTQKGARQKKINEWLGIKNETEDTHSWRTRTISRTTRNALGTWARSTARRQRRC

SEQ ID NO: 63159 - protein, 728 aa, Homo sapiens; identical to SEQ ID NO: 62516
  Payload ID: 12597
  Gene Symbol: PIK3R2
  Gene Name: phosphoinositide-3-kinase, regulatory subunit 2 (beta)
  Uniprot ID: O00459
  ENSP ID: ENSP00000477864

SEQ ID NO: 63160 - protein, 481 aa, Homo sapiens; identical to SEQ ID NO: 63157
  Payload ID: 12597
  Gene Symbol: PIK3R2
  Gene Name: phosphoinositide-3-kinase, regulatory subunit 2 (beta)
  ENSP ID: ENSP00000484714

SEQ ID NO: 63161 - protein, 461 aa, Homo sapiens
  Payload ID: 12598
  Gene Symbol: PIK3R3
  Gene Name: phosphoinositide-3-kinase, regulatory subunit 3 (gamma)
  Uniprot ID: Q92569
  ENSP ID: ENSP00000262741
MYNTVWSMDRDDADWREVMMPYSTELIFYIEMDPPALPPKPPKPMTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTSQEIQMKRTAIEAFNETIKIFEEQCHTQEQHSKEYIERFRREGNEKEIERIMMNYDKLKSRLGEIHDSKMRLEQDLKNQALDNREIDKKMNSIKPDLIQLRKIRDQHLVWLNHKGVRQKRLNVWLGIKNEDADENYFINEEDENLPHYDEKTWFVEDINRVQAEDLLYGKPDGAFLIRESSKKGCYACSVVADGEVKHCVIYSTARGYGFAEPYNLYSSLKELVLHYQQTSLVQHNDSLNVRLAYPVHAQMPSLCR

SEQ ID NO: 63162 - protein, 461 aa, Homo sapiens; identical to SEQ ID NO: 63161
  Payload ID: 12598
  Gene Symbol: PIK3R3
  Gene Name: phosphoinositide-3-kinase, regulatory subunit 3 (gamma)
  Uniprot ID: Q92569
  ENSP ID: ENSP00000361075

SEQ ID NO: 63163 - protein, 402 aa, Homo sapiens
  Payload ID: 12598
  Gene Symbol: PIK3R3
  Gene Name: phosphoinositide-3-kinase, regulatory subunit 3 (gamma)
  Uniprot ID: Q92569
  ENSP ID: ENSP00000391431
MYNTVWSMDRDDADWREVMMPYSTELIFYIEMDPPALPPKPPKPMTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTSQEIQMKRTAIEAFNETIKIFEEQCHTQEQHSKEYIERFRREGNEKEIERWLNHKGVRQKRLNVWLGIKNEDADENYFINEEDENLPHYDEKTWFVEDINRVQAEDLLYGKPDGAFLIRESSKKGCYACSVVADGEVKHCVIYSTARGYGFAEPYNLYSSLKELVLHYQQTSLVQHNDSLNVRLAYPVHAQMPSLCR

SEQ ID NO: 63164 - protein, 461 aa, Homo sapiens; identical to SEQ ID NO: 63161
  Payload ID: 12598
  Gene Symbol: PIK3R3
  Gene Name: phosphoinositide-3-kinase, regulatory subunit 3 (gamma)
  Uniprot ID: Q92569
  ENSP ID: ENSP00000412546

SEQ ID NO: 63165 - protein, 206 aa, Homo sapiens
  Payload ID: 12598
  Gene Symbol: PIK3R3
  Gene Name: phosphoinositide-3-kinase, regulatory subunit 3 (gamma)
  ENSP ID: ENSP00000416647
MYNTVWSMDRDDADWREVMMPYSTELIFYIEMDPPALPPKPPKPMTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTS

SEQ ID NO: 63166 - protein, 507 aa, Homo sapiens
  Payload ID: 12599
  Gene Symbol:
  Gene Name: phosphoinositide-3-kinase, regulatory subunit 3 (gamma) [Source:EntrezGene
  Acc:8503]
  ENSP ID: ENSP00000439913
MGPSRLVRGPRPQGMRSPYRRPGMGWPRPRFPRMFKCSRRRYQQGLRGRTASSAAINPATRAMGINNTHTDTTIVWIFPPQALPPKPPKPMTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTSQEIQMKRTAIEAFNETIKIFEEQCHTQEQHSKEYIERFRREGNEKEIERIMMNYDKLKSRLGEIHDSKMRLEQDLKNQALDNREIDKKMNSIKPDLIQLRKIRDQHLVWLNHKGVRQKRLNVWLGIKNEDADENYFINEEDENLPHYDEKTWFVEDINRVQAEDLLYGKPDGAFLIRESSKKGCYACSVVADGEVKHCVIYSTARGYGFAEPYNLYSSLKELVLHYQQTSLVQHNDSLNVRLAYPVHAQMPSLCR

SEQ ID NO: 63167 - protein, 1358 aa, Homo sapiens
  Payload ID: 12600
  Gene Symbol: PIK3R4
  Gene Name: phosphoinositide-3-kinase, regulatory subunit 4
  Uniprot ID: Q99570
  ENSP ID: ENSP00000349205
MGNQLAGIAPSQILSVESYFSDIHDFEYDKSLGSTRFFKVARAKHREGLVVVKVFAIQDPTLPLTSYKQELEELKIRLNSAQNCLPFQKASEKASEKAAMLFRQYVRDNLYDRISTRPFLNNIEKRWIAFQILTAVDQAHKSGVRHGDIKTENVMVTSWNWVLLTDFASFKPTYLPEDNPADFNYFFDTSRRRTCYIAPERFVDGGMFATELEYMRDPSTPLVDLNSNQRTRGELKRAMDIFSAGCVIAELFTEGVPLFDLSQLLAYRNGHFFPEQVLNKIEDHSIRELVTQMIHREPDKRLEAEDYLKQQRGNAFPEIFYTFLQPYMAQFAKETFLSADERILVIRKDLGNIIHNLCGHDLPEKAEGEPKENGLVILVSVITSCLQTLKYCDSKLAALELILHLAPRLSVEILLDRITPYLLHFSNDSVPRVRAEALRTLTKVLALVKEVPRNDINIYPEYILPGIAHLAQDDATIVRLAYAENIALLAETALRFLELVQLKNLNMENDPNNEEIDEVTHPNGNYDTELQALHEMVQQKVVTLLSDPENIVKQTLMENGITRLCVFFGRQKANDVLLSHMITFLNDKNDWHLRGAFFDSIVGVAAYVGWQSSSILKPLLQQGLSDAEEFVIVKALYALTCMCQLGLLQKPHVYEFASDIAPFLCHPNLWIRYGAVGFITVVARQISTADVYCKLMPYLDPYITQPIIQIERKLVLLSVLKEPVSRSIFDYALRSKDITSLFRHLHMRQKKRNGSLPDCPPPEDPAIAQLLKKLLSQGMTEEEEDKLLALKDFMMKSNKAKANIVDQSHLHDSSQKGVIDLAALGITGRQVDLVKTKQEPDDKRARKHVKQDSNVNEEWKSMFGSLDPPNMPQALPKGSDQEVIQTGKPPRSESSAGICVPLSTSSQVPEVTTVQNKKPVIPVLSSTILPSTYQIRITTCKTELQQLIQQKREQCNAERIAKQMMENAEWESKPPPPGWRPKGLLVAHLHEHKSAVNRIRVSDEHSLFATCSNDGTVKIWNSQKMEGKTTTTRSILTYSRIGGRVKTLTFCQGSHYLAIASDNGAVQLLGIEASKLPKSPKIHPLQSRILDQKEDGCVVDMHHFNSGAQSVLAYATVNGSLVGWDLRSSSNAWTLKHDLKSGLITSFAVDIHQCWLCIGTSSGTMACWDMRFQLPISSHCHPSRARIRRLSMHPLYQSWVIAAVQGNNEVSMWDMETGDRRFTLWASSAPPLSELQPSPHSVHGIYCSPADGNPILLTAGSDMKIRFWDLAYPERSYVVAGSTSSPSVSYYRKIIEGTEVVQEIQNKQKVGPSDDTPRRGPESLPVGHHDIITDVATFQTTQGFIVTASRDGIVKVWK

SEQ ID NO: 63168 - protein, 126 aa, Homo sapiens
  Payload ID: 12600
  Gene Symbol: PIK3R4
  Gene Name: phosphoinositide-3-kinase, regulatory subunit 4
  ENSP ID: ENSP00000422767
MCQLGLLQKPHVYEFASDIAPFLCHPNLWIRYGAVGFITVVARQISTADVYCKLMPYLDPYITQPIIQIERKLVLLSVLKEPVSRSIFDYALRSKDITSLFRHLHMRQKKRNGSLPDCPPPEDPAI

SEQ ID NO: 63169 - protein, 129 aa, Homo sapiens
  Payload ID: 12600
  Gene Symbol: PIK3R4
  Gene Name: phosphoinositide-3-kinase, regulatory subunit 4
  ENSP ID: ENSP00000424274
MCQLGLLQKPHVYEFASDIAPFLCHPNLWIRYGAVGFITVVARQISTADVYCKLMPYLDPYITQPIIQIERKLVLLSVLKEPVSRSIFDYALRSKDITSLFRHLHMRQKKRNGSLPDCPPPEDPAIAQL

SEQ ID NO: 63170 - protein, 193 aa, Homo sapiens
  Payload ID: 12600
  Gene Symbol: PIK3R4
  Gene Name: phosphoinositide-3-kinase, regulatory subunit 4
  ENSP ID: ENSP00000427302
MCQLGLLQKPHVYEFASDIAPFLCHPNLWIRYGAVGFITVVARQISTADVYCKLMPYLDPYITQPIIQIERKLVLLSVLKEPVSRSIFDYALRSKDITSLFRHLHMRQKKRNGSLPDCPPPEDPAIAQLLKKLLSQGMTEEEEDKLLALKDFMMKSNKAKANIVDQSHLHDSSQKGVIDLAALGITGRQVDLV

SEQ ID NO: 63171 - protein, 211 aa, Homo sapiens
  Payload ID: 12601
  Gene Symbol: PIK3R5
  Gene Name: phosphoinositide-3-kinase, regulatory subunit 5
  ENSP ID: ENSP00000269300
MQPGATTCTEDRIQHALERCLHGLSLSRRSTSWSAGLCLNCWSLQELVSRDPGHFLILLEQILQKTREVQEKGTYDLLTPLALLFYSTVLCTPHFPPDSDLLLKAASTYHRFLTWPVPYCSICQELLTFIDAELKAPGISYQRLVRAEQGLPIRSHRSSTVPRPWQSLRTSSRRPQRHRSWHLASGMLQRPGGGSGPSCRRWEKKLASLGC

SEQ ID NO: 63172 - protein, 880 aa, Homo sapiens
  Payload ID: 12601
  Gene Symbol: PIK3R5
  Gene Name: phosphoinositide-3-kinase, regulatory subunit 5
  Uniprot ID: Q8WYR1
  ENSP ID: ENSP00000392812
MQPGATTCTEDRIQHALERCLHGLSLSRRSTSWSAGLCLNCWSLQELVSRDPGHFLILLEQILQKTREVQEKGTYDLLTPLALLFYSTVLCTPHFPPDSDLLLKAASTYHRFLTWPVPYCSICQELLTFIDAELKAPGISYQRLVRAEQGLPIRSHRSSTVTVLLLNPVEVQAEFLAVANKLSTPGHSPHSAYTTLLLHAFQATFGAHCDVPGLHCRLQAKTLAELEDIFTETAEAQELASGIGDAAEARRWLRTKLQAVGEKAGFPGVLDTAKPGKLHTIPIPVARCYTYSWSQDSFDILQEILLKEQELLQPGILGDDEEEEEEEEEVEEDLETDGHCAERDSLLSTSSLASHDSTLSLASSQASGPALSRHLLTSFVSGLSDGMDSGYVEDSEESSSEWPWRRGSQERRGHRRPGQKFIRIYKLFKSTSQLVLRRDSRSLEGSSDTALPLRRAGSLCSPLDEPVSPPSRAQRSRSLPQPKLGTQLPSWLLAPASRPQRRRPFLSGDEDPKASTLRVVVFGSDRISGKVARAYSNLRRLENNRPLLTRFFKLQFFYVPVKRSHGTSPGACPPPRSQTPSPPTDSPRHASPGELGTTPWEESTNDISHYLGMLDPWYERNVLGLMHLPPEVLCQQSLKAEAQALEGSPTQLPILADMLLYYCRFAARPVLLQVYQTELTFITGEKTTEIFIHSLELGHSAATRAIKASGPGSKRLGIDGDREAVPLTLQIIYSKGAISGRSRWSNLEKVCTSVNLNKACRKQEELDSSMEALTLNLTEVVKRQNSKSKKGFNQISTSQIKVDKVQIIGSNSCPFAVCLDQDERKILQSVVRCEVSPCYKPEKSDLSSPPQTPPDLPAQAAPDLCSLLCLPIMTFSGALP

SEQ ID NO: 63173 - protein, 44 aa, Homo sapiens
  Payload ID: 12601
  Gene Symbol: PIK3R5
  Gene Name: phosphoinositide-3-kinase, regulatory subunit 5
  ENSP ID: ENSP00000461966
MQPGATTCTEDRIQHALERCLHGLSLSRRSTSWSAGLCLNCWSL

SEQ ID NO: 63174 - protein, 880 aa, Homo sapiens; identical to SEQ ID NO: 63172
  Payload ID: 12601
  Gene Symbol: PIK3R5
  Gene Name: phosphoinositide-3-kinase, regulatory subunit 5
  Uniprot ID: Q8WYR1
  ENSP ID: ENSP00000462433

SEQ ID NO: 63175 - protein, 879 aa, Homo sapiens
  Payload ID: 12601
  Gene Symbol: PIK3R5
  Gene Name: phosphoinositide-3-kinase, regulatory subunit 5
  ENSP ID: ENSP00000462680
MQPGATTCTEDRIQHALERCLHGLSLSRRSTSWSAGLCLNCWSLQELVSRDPGHFLILLEQILQKTREVQEKGTYDLLTPLALLFYSTVLCTPHFPPDSDLLLKAASTYHRFLTWPVPYCSICQELLTFIDAELKAPGISYQRLVRAEQGLPIRSHRSSTVTVLLLNPVEVQAEFLAVANKLSTPGHSPHSAYTTLLLHAFQATFGAHCDVPGLHCRLQAKTLAELEDIFTETAEAQELASGIGDAAEARRWLRTKLQAVGEKAGFPGVLDTAKPGKLHTIPIPVARCYTYSWSQDSFDILQEILLKEQELLQPGILGDDEEEEEEEEEVEEDLETDGHCAERDSLLSTSSLASHDSTLSLASSQASGPALSRHLLTSFVSGLSDGMDSGYVEDSEESSSEWPWRRGSQERRGHRRPGQKFIRIYKLFKSTSQLVLRRDSRSLEGSSDTALPLRRAGSLCSPLDEPVSPPSRAQRSRSLPQPKLGTQLPSWLLAPASRPQRRRPFLSGDEDPKASTLRVVVFGSDRISGKVARAYSNLRRLENNRPLLTRFFKLQFFYVPVKRSHGTSPGACPPPRSQTPSPPTDSPRHASPGELGTTPWEESTNDISHYLGMLDPWYERNVLGLMHLPPEVLCQSLKAEAQALEGSPTQLPILADMLLYYCRFAARPVLLQVYQTELTFITGEKTTEIFIHSLELGHSAATRAIKASGPGSKRLGIDGDREAVPLTLQIIYSKGAISGRSRWSNLEKVCTSVNLNKACRKQEELDSSMEALTLNLTEVVKRQNSKSKKGFNQISTSQIKVDKVQIIGSNSCPFAVCLDQDERKILQSVVRCEVSPCYKPEKSDLSSPPQTPPDLPAQAAPDLCSLLCLPIMTFSGALP

SEQ ID NO: 63176 - protein, 93 aa, Homo sapiens
  Payload ID: 12601
  Gene Symbol: PIK3R5
  Gene Name: phosphoinositide-3-kinase, regulatory subunit 5
  ENSP ID: ENSP00000462824
GRSRWSNLEKVCTSVNLNKACRKQEELDSSMEALTLNLTEVVKRQNSKSKKGFNQISTSQIKVDKVQIIGSNSCPFAVCLDQDERKILQSVVR

SEQ ID NO: 63177 - protein, 494 aa, Homo sapiens
  Payload ID: 12601
  Gene Symbol: PIK3R5
  Gene Name: phosphoinositide-3-kinase, regulatory subunit 5
  Uniprot ID: Q8WYR1
  ENSP ID: ENSP00000477795
MDSGYVEDSEESSSEWPWRRGSQERRGHRRPGQKFIRIYKLFKSTSQLVLRRDSRSLEGSSDTALPLRRAGSLCSPLDEPVSPPSRAQRSRSLPQPKLGTQLPSWLLAPASRPQRRRPFLSGDEDPKASTLRVVVFGSDRISGKVARAYSNLRRLENNRPLLTRFFKLQFFYVPVKRSHGTSPGACPPPRSQTPSPPTDSPRHASPGELGTTPWEESTNDISHYLGMLDPWYERNVLGLMHLPPEVLCQQSLKAEAQALEGSPTQLPILADMLLYYCRFAARPVLLQVYQTELTFITGEKTTEIFIHSLELGHSAATRAIKASGPGSKRLGIDGDREAVPLTLQIIYSKGAISGRSRWSNLEKVCTSVNLNKACRKQEELDSSMEALTLNLTEVVKRQNSKSKKGFNQISTSQIKVDKVQIIGSNSCPFAVCLDQDERKILQSVVRCEVSPCYKPEKSDLSSPPQTPPDLPAQAAPDLCSLLCLPIMTFSGALP

SEQ ID NO: 63178 - protein, 494 aa, Homo sapiens; identical to SEQ ID NO: 63177
  Payload ID: 12601
  Gene Symbol: PIK3R5
  Gene Name: phosphoinositide-3-kinase, regulatory subunit 5
  Uniprot ID: Q8WYR1
  ENSP ID: ENSP00000484211

SEQ ID NO: 63179 - protein, 494 aa, Homo sapiens; identical to SEQ ID NO: 63177
  Payload ID: 12601
  Gene Symbol: PIK3R5
  Gene Name: phosphoinositide-3-kinase, regulatory subunit 5
  Uniprot ID: Q8WYR1
  ENSP ID: ENSP00000485280

SEQ ID NO: 63180 - protein, 754 aa, Homo sapiens
  Payload ID: 12602
  Gene Symbol: PIK3R6
  Gene Name: phosphoinositide-3-kinase, regulatory subunit 6
  Uniprot ID: Q5UE93
  ENSP ID: ENSP00000480157
MESSDVELDLQRSVQAVLRELSTQAPALQSNQGMWRWSLHKKVERDPGKSPVLVRILLRELEKAESQDLRHVIIPLLHTVMYVLTKATGITEELYQRIYAFCTRLLTLPTPYCTVALDCAIRLKTEMAVPGTLYQRMVIAEQNLTNELYPYQERVFLFVDPELVSASVCSALLLEIEAAQAQQTPETCMRHVVSHALQAALGEACHAGALHRKLQASPRRTLEHYFHAVVAALEQMASEASPSREGHVERLEEIYCSLLGPAAGRCGGDLVQERPPSIPLPSPYITFHLWTGEEQLWKELVLFLRPRSQLRLSADLEVLDLQGLRPDRELARVSVLSTDSGIERDLPTGADELPAPGSPEMERAGLQRKGGIKKRAWPLDFLMPGSWDGPPGLHRRTGRPSGDGEMLPGVSRLHTARVLVLGDDRMLGRLAQAYHRLRKRETQKFCLTPRLSLQLYYIPVLAPEKPAASRQPELGELATFLGRVDPWYQSNVNTLCPAIHKLAEMPPSLDTSRTVDPFILDVITYYIRMGTQPIYFQIYTVKIFFSDLSQDPTEDIFLIELKVKIQDSKFPKDGFSPRRRGVAEGPGAELSLCYQKALLSHRPREVTVSLRATGLILKAIPASDTEVSGSSHCPLPAAPVTDHTCLNVNVTEVVKSSNLAGKSFSTVTNTFRTNNIQIQSRDQRLLTLSLDKDDQRTFRDVVRFEVAPCPEPCSGAQKSKAPWLNLHGQQEVEAIKAKPKPLLMPINTFSGIVQ

SEQ ID NO: 63181 - protein, 100 aa, Homo sapiens
  Payload ID: 12602
  Gene Symbol: PIK3R6
  Gene Name: phosphoinositide-3-kinase, regulatory subunit 6
  ENSP ID: ENSP00000480685
MESSDVELDLQRSVQAVLRELSTQAPALQSNQGMWRWSLHKKVERDPGKSPVLVRILLRELEKVSSWTSGRKTGMKGREGPIGQGLSPGSAISHKLWLPA

SEQ ID NO: 63182 - protein, 754 aa, Homo sapiens; identical to SEQ ID NO: 63180
  Payload ID: 12602
  Gene Symbol: PIK3R6
  Gene Name: phosphoinositide-3-kinase, regulatory subunit 6
  Uniprot ID: Q5UE93
  ENSP ID: ENSP00000482341

SEQ ID NO: 63183 - protein, 100 aa, Homo sapiens; identical to SEQ ID NO: 63181
  Payload ID: 12602
  Gene Symbol: PIK3R6
  Gene Name: phosphoinositide-3-kinase, regulatory subunit 6
  ENSP ID: ENSP00000484155

SEQ ID NO: 63184 - protein, 137 aa, Homo sapiens
  Payload ID: 12603
  Gene Symbol: PIRT
  Gene Name: phosphoinositide-interacting regulator of transient receptor potential channels
  Uniprot ID: P0C851
  ENSP ID: ENSP00000462046
MTMETLPKVLEVDEKSPEAKDLLPSQTASSLCISSRSESVWTTTPRSNWEIYRKPIVIMSVGGAILLFGVVITCLAYTLKLSDKSLSILKMVGPGFLSLGLMMLVCGLVWVPIIKKKQKHRQKSNFLRSLKSFFLTR

SEQ ID NO: 63185 - protein, 52 aa, Homo sapiens
  Payload ID: 12604
  Gene Symbol: PLN
  Gene Name: phospholamban
  Uniprot ID: P26678
  ENSP ID: ENSP00000350132
MEKVQYLTRSAIRRASTIEMPQQARQKLQNLFINFCLILICLLLICIIVMLL

SEQ ID NO: 63186 - protein, 456 aa, Homo sapiens
  Payload ID: 12605
  Gene Symbol: PLA1A
  Gene Name: phospholipase A1 member A
  Uniprot ID: Q53H76
  ENSP ID: ENSP00000273371
MPPGPWESCFWVGGLILWLSVGSSGDAPPTPQPKCADFQSANLFEGTDLKVQFLLFVPSNPSCGQLVEGSSDLQNSGFNATLGTKLIIHGFRVLGTKPSWIDTFIRTLLRATNANVIAVDWIYGSTGVYFSAVKNVIKLSLEISLFLNKLLVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 63187 - protein, 224 aa, Homo sapiens
  Payload ID: 12605
  Gene Symbol: PLA1A
  Gene Name: phospholipase A1 member A
  ENSP ID: ENSP00000417295
NVIKLSLEISLFLNKLLVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCNAFQLLTVAPNHGISLKLGCW

SEQ ID NO: 63188 - protein, 440 aa, Homo sapiens
  Payload ID: 12605
  Gene Symbol: PLA1A
  Gene Name: phospholipase A1 member A
  Uniprot ID: Q53H76
  ENSP ID: ENSP00000417326
MPPGPWESCFWVGGLILWLSVGSSGDAPPTPQPKCADFQSANLFEGTDLKVQFLLFVPSNPSCGQLVEGSSDLQNSGFNATLGTKLIIHGFRVLGTKPSWIDTFIRTLLRATNANVIAVDWIYGSTGVYFSAVKNVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 63189 - protein, 440 aa, Homo sapiens
  Payload ID: 12605
  Gene Symbol: PLA1A
  Gene Name: phospholipase A1 member A
  ENSP ID: ENSP00000418793
MHKSSSIWGDAPPTPQPKCADFQSANLFEGTDLKVQFLLFVPSNPSCGQLVEGSSDLQNSGFNATLGTKLIIHGFRVLGTKPSWIDTFIRTLLRATNANVIAVDWIYGSTGVYFSAVKNVIKLSLEISLFLNKLLVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 63190 - protein, 283 aa, Homo sapiens
  Payload ID: 12605
  Gene Symbol: PLA1A
  Gene Name: phospholipase A1 member A
  Uniprot ID: Q53H76
  ENSP ID: ENSP00000420625
MVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 63191 - protein, 116 aa, Homo sapiens
  Payload ID: 12606
  Gene Symbol: PINLYP
  Gene Name: phospholipase A2 inhibitor and LY6/PLAUR domain containing
  Uniprot ID: A6NC86
  ENSP ID: ENSP00000456310
MGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 63192 - protein, 116 aa, Homo sapiens; identical to SEQ ID NO: 63191
  Payload ID: 12606
  Gene Symbol: PINLYP
  Gene Name: phospholipase A2 inhibitor and LY6/PLAUR domain containing
  Uniprot ID: A6NC86
  ENSP ID: ENSP00000457369

SEQ ID NO: 63193 - protein, 116 aa, Homo sapiens; identical to SEQ ID NO: 63191
  Payload ID: 12606
  Gene Symbol: PINLYP
  Gene Name: phospholipase A2 inhibitor and LY6/PLAUR domain containing
  Uniprot ID: A6NC86
  ENSP ID: ENSP00000457623

SEQ ID NO: 63194 - protein, 204 aa, Homo sapiens
  Payload ID: 12606
  Gene Symbol: PINLYP
  Gene Name: phospholipase A2 inhibitor and LY6/PLAUR domain containing
  Uniprot ID: A6NC86
  ENSP ID: ENSP00000469886
MRLSRRPETFLLAFVLLCTLLGLGCPLHCEICTAAGSRCHGQMKTCSSDKDTCVLLVGKATSKGKELVHTYKGCIRSQDCYSGVISTTMGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 63195 - protein, 228 aa, Homo sapiens
  Payload ID: 12606
  Gene Symbol: PINLYP
  Gene Name: phospholipase A2 inhibitor and LY6/PLAUR domain containing
  Uniprot ID: A6NC86
  ENSP ID: ENSP00000479240
MWVQTHPSSASYKSWGPGTADTHTMRLSRRPETFLLAFVLLCTLLGLGCPLHCEICTAAGSRCHGQMKTCSSDKDTCVLLVGKATSKGKELVHTYKGCIRSQDCYSGVISTTMGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 63196 - protein, 1463 aa, Homo sapiens
  Payload ID: 12607
  Gene Symbol: PLA2R1
  Gene Name: phospholipase A2 receptor 1, 180kDa
  Uniprot ID: Q13018
  ENSP ID: ENSP00000283243
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHSIIPLAVVLTLIVIVAICTLSFCIYKHNGGFFRRLAGFRNPYYPATNFSTVYLEENILISDLEKSDQ

SEQ ID NO: 63197 - protein, 1324 aa, Homo sapiens
  Payload ID: 12607
  Gene Symbol: PLA2R1
  Gene Name: phospholipase A2 receptor 1, 180kDa
  Uniprot ID: Q13018
  ENSP ID: ENSP00000376524
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNSK

SEQ ID NO: 63198 - protein, 148 aa, Homo sapiens
  Payload ID: 12608
  Gene Symbol: PLA2G1B
  Gene Name: phospholipase A2, group IB (pancreas)
  Uniprot ID: P04054
  ENSP ID: ENSP00000312286
MKLLVLAVLLTVAAADSGISPRAVWQFRKMIKCVIPGSDPFLEYNNYGCYCGLGGSGTPVDELDKCCQTHDNCYDQAKKLDSCKFLLDNPYTHTYSYSCSGSAITCSSKNKECEAFICNCDRNAAICFSKAPYNKAHKNLDTKKYCQS

SEQ ID NO: 63199 - protein, 70 aa, Homo sapiens
  Payload ID: 12608
  Gene Symbol: PLA2G1B
  Gene Name: phospholipase A2, group IB (pancreas)
  ENSP ID: ENSP00000413594
MKLLVLAVLLTVAAADSGISPRAVWQFRKMIKCVIPGSDPFLEYNNYGCYCGLGGSGTPVDELDKQKQRV

SEQ ID NO: 63200 - protein, 119 aa, Homo sapiens
  Payload ID: 12608
  Gene Symbol: PLA2G1B
  Gene Name: phospholipase A2, group IB (pancreas)
  ENSP ID: ENSP00000447233
MIKCVIPGSDPFLEYNNYGCYCGLGGSGTPVDELDKCCQTHDNCYDQAKKLDSCKFLLDNPYTHTYSYSCSGSAITCSSKNKECEAFICNCDRNAAICFSKAPYNKAHKNLDTKKYCQS

SEQ ID NO: 63201 - protein, 144 aa, Homo sapiens
  Payload ID: 12609
  Gene Symbol: PLA2G2A
  Gene Name: phospholipase A2, group IIA (platelets, synovial fluid)
  Uniprot ID: P14555
  ENSP ID: ENSP00000364252
MKTLLLLAVIMIFGLLQAHGNLVNFHRMIKLTTGKEAALSYGFYGCHCGVGGRGSPKDATDRCCVTHDCCYKRLEKRGCGTKFLSYKFSNSGSRITCAKQDSCRSQLCECDKAAATCFARNKTTYNKKYQYYSNKHCRGSTPRC

SEQ ID NO: 63202 - protein, 144 aa, Homo sapiens; identical to SEQ ID NO: 63201
  Payload ID: 12609
  Gene Symbol: PLA2G2A
  Gene Name: phospholipase A2, group IIA (platelets, synovial fluid)
  Uniprot ID: P14555
  ENSP ID: ENSP00000383364

SEQ ID NO: 63203 - protein, 150 aa, Homo sapiens
  Payload ID: 12610
  Gene Symbol: PLA2G2C
  Gene Name: phospholipase A2, group IIC
  ENSP ID: ENSP00000247992
MLIATSFFLFFSSVVAAPTHSSFWQFQRRVKHITGRSAFFSYYGYGCYCGLGDKGIPVDDTDSPSSPSPYEKLKEFSCQPVLNSYQFHIVNGAVVCGCTLGPGASCHCRLKACECDKQSVHCFKESLPTYEKNFKQFSSQPRCGRHKPWC

SEQ ID NO: 63204 - protein, 149 aa, Homo sapiens
  Payload ID: 12610
  Gene Symbol: PLA2G2C
  Gene Name: phospholipase A2, group IIC
  Uniprot ID: Q5R387
  ENSP ID: ENSP00000389335
MKVIAILTLLLFCSPTHSSFWQFQRRVKHITGRSAFFSYYGYGCYCGLGDKGIPVDDTDRHSPSSPSPYEKLKEFSCQPVLNSYQFHIVNGAVVCGCTLGPGASCHCRLKACECDKQSVHCFKESLPTYEKNFKQFSSQPRCGRHKPWC

SEQ ID NO: 63205 - protein, 145 aa, Homo sapiens
  Payload ID: 12611
  Gene Symbol: PLA2G2D
  Gene Name: phospholipase A2, group IID
  Uniprot ID: Q9UNK4
  ENSP ID: ENSP00000364246
MELALLCGLVVMAGVIPIQGGILNLNKMVKQVTGKMPILSYWPYGCHCGLGGRGQPKDATDWCCQTHDCCYDHLKTQGCSIYKDYYRYNFSQGNIHCSDKGSWCEQQLCACDKEVAFCLKRNLDTYQKRLRFYWRPHCRGQTPGC

SEQ ID NO: 63206 - protein, 62 aa, Homo sapiens
  Payload ID: 12611
  Gene Symbol: PLA2G2D
  Gene Name: phospholipase A2, group IID
  ENSP ID: ENSP00000482871
MELALLCGLVVMAGVIPIQGGILNLNKMVKQVTGKMPILSYWPYGCHCGLGGRGQPKDATDC

SEQ ID NO: 63207 - protein, 142 aa, Homo sapiens
  Payload ID: 12612
  Gene Symbol: PLA2G2E
  Gene Name: phospholipase A2, group IIE
  Uniprot ID: Q9NZK7
  ENSP ID: ENSP00000364257
MKSPHVLVFLCLLVALVTGNLVQFGVMIEKMTGKSALQYNDYGCYCGIGGSHWPVDQTDWCCHAHDCCYGRLEKLGCEPKLEKYLFSVSERGIFCAGRTTCQRLTCECDKRAALCFRRNLGTYNRKYAHYPNKLCTGPTPPC

SEQ ID NO: 63208 - protein, 211 aa, Homo sapiens
  Payload ID: 12613
  Gene Symbol: PLA2G2F
  Gene Name: phospholipase A2, group IIF
  Uniprot ID: Q9BZM2
  ENSP ID: ENSP00000364243
MADGAKANPKGFKKKVLDRCFSGWRGPRFGASCPSRTSRSSLGMKKFFTVAILAGSVLSTAHGSLLNLKAMVEAVTGRSAILSFVGYGCYCGLGGRGQPKDEVDWCCHAHDCCYQELFDQGCHPYVDHYDHTIENNTEIVCSDLNKTECDKQTCMCDKNMVLCLMNQTYREEYRGFLNVYCQGPTPNCSIYEPPPEEVTCSHQSPAPPAPP

SEQ ID NO: 63209 - protein, 509 aa, Homo sapiens
  Payload ID: 12614
  Gene Symbol: PLA2G3
  Gene Name: phospholipase A2, group III
  Uniprot ID: Q9NZ20
  ENSP ID: ENSP00000215885
MGVQAGLFGMLGFLGVALGGSPALRWYRTSCHLTKAVPGNPLGYLSFLAKDAQGLALIHARWDAHRRLQSCSWEDEPELTAAYGALCAHETAWGSFIHTPGPELQRALATLQSQWEACRALEESPAGARKKRAAGQSGVPGGGHQREKRGWTMPGTLWCGVGDSAGNSSELGVFQGPDLCCREHDRCPQNISPLQYNYGIRNYRFHTISHCDCDTRFQQCLQNQHDSISDIVGVAFFNVLEIPCFVLEEQEACVAWYWWGGCRMYGTVPLARLQPRTFYNASWSSRATSPTPSSRSPAPPKPRQKQHLRKGPPHQKGSKRPSKANTTALQDPMVSPRLDVAPTGLQGPQGGLKPQGARWVCRSFRRHLDQCEHQIGPREIEFQLLNSAQEPLFHCNCTRRLARFLRLHSPPEVTNMLWELLGTTCFKLAPPLDCVEGKNCSRDPRAIRVSARHLRRLQQRRHQLQDKGTDERQPWPSEPLRGPMSFYNQCLQLTQAARRPDRQQKSWSQ

SEQ ID NO: 63210 - protein, 749 aa, Homo sapiens
  Payload ID: 12615
  Gene Symbol: PLA2G4A
  Gene Name: phospholipase A2, group IVA (cytosolic, calcium-dependent)
  Uniprot ID: P47712
  ENSP ID: ENSP00000356436
MSFIDPYQHIIVEHQYSHKFTVVVLRATKVTKGAFGDMLDTPDPYVELFISTTPDSRKRTRHFNNDINPVWNETFEFILDPNQENVLEITLMDANYVMDETLGTATFTVSSMKVGEKKEVPFIFNQVTEMVLEMSLEVCSCPDLRFSMALCDQEKTFRQQRKEHIRESMKKLLGPKNSEGLHSARDVPVVAILGSGGGFRAMVGFSGVMKALYESGILDCATYVAGLSGSTWYMSTLYSHPDFPEKGPEEINEELMKNVSHNPLLLLTPQKVKRYVESLWKKKSSGQPVTFTDIFGMLIGETLIHNRMNTTLSSLKEKVNTAQCPLPLFTCLHVKPDVSELMFADWVEFSPYEIGMAKYGTFMAPDLFGSKFFMGTVVKKYEENPLHFLMGVWGSAFSILFNRVLGVSGSQSRGSTMEEELENITTKHIVSNDSSDSDDESHEPKGTENEDAGSDYQSDNQASWIHRMIMALVSDSALFNTREGRAGKVHNFMLGLNLNTSYPLSPLSDFATQDSFDDDELDAAVADPDEFERIYEPLDVKSKKIHVVDSGLTFNLPYPLILRPQRGVDLIISFDFSARPSDSSPPFKELLLAEKWAKMNKLPFPKIDPYVFDREGLKECYVFKPKNPDMEKDCPTIIHFVLANINFRKYRAPGVPRETEEEKEIADFDIFDDPESPFSTFNFQYPNQAFKRLHDLMHFNTLNNIDVIKEAMVESIEYRRQNPSRCSVSLSNVEARRFFNKEFLSKPKA

SEQ ID NO: 63211 - protein, 781 aa, Homo sapiens; identical to SEQ ID NO: 42300
  Payload ID: 12616
  Gene Symbol: PLA2G4B
  Gene Name: phospholipase A2, group IVB (cytosolic)
  Uniprot ID: P0C869
  ENSP ID: ENSP00000396045

SEQ ID NO: 63212 - protein, 30 aa, Homo sapiens
  Payload ID: 12616
  Gene Symbol: PLA2G4B
  Gene Name: phospholipase A2, group IVB (cytosolic)
  ENSP ID: ENSP00000456919
  MOD_RES (1)..(1): Any amino acid
XSLDYNLHGAFQLLEALRQAVQRRRQRRPH

SEQ ID NO: 63213 - protein, 527 aa, Homo sapiens
  Payload ID: 12617
  Gene Symbol: PLA2G4C
  Gene Name: phospholipase A2, group IVC (cytosolic, calcium-independent)
  Uniprot ID: Q9UP65
  ENSP ID: ENSP00000346228
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAG

SEQ ID NO: 63214 - protein, 43 aa, Homo sapiens
  Payload ID: 12617
  Gene Symbol: PLA2G4C
  Gene Name: phospholipase A2, group IVC (cytosolic, calcium-independent)
  ENSP ID: ENSP00000468972
MRTRPRPRLRVSLLLPRLECNGMISAHWHLHLLSSSDSPPSAS

SEQ ID NO: 63215 - protein, 541 aa, Homo sapiens
  Payload ID: 12617
  Gene Symbol: PLA2G4C
  Gene Name: phospholipase A2, group IVC (cytosolic, calcium-independent)
  Uniprot ID: Q9UP65
  ENSP ID: ENSP00000469473
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAGLYYPKDSARSCCLA

SEQ ID NO: 63216 - protein, 130 aa, Homo sapiens
  Payload ID: 12617
  Gene Symbol: PLA2G4C
  Gene Name: phospholipase A2, group IVC (cytosolic, calcium-independent)
  ENSP ID: ENSP00000469528
  MOD_RES (1)..(1): Any amino acid
XMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFEHPRSATSNELLCMSVSSAVKLG

SEQ ID NO: 63217 - protein, 213 aa, Homo sapiens
  Payload ID: 12617
  Gene Symbol: PLA2G4C
  Gene Name: phospholipase A2, group IVC (cytosolic, calcium-independent)
  ENSP ID: ENSP00000470418
GSALGNTEVIREYIFGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETG

SEQ ID NO: 63218 - protein, 39 aa, Homo sapiens
  Payload ID: 12617
  Gene Symbol: PLA2G4C
  Gene Name: phospholipase A2, group IVC (cytosolic, calcium-independent)
  ENSP ID: ENSP00000471196
MGSSEVSIIPGLQKEEKAAVERRRLHVLKALKKLRIEAD

SEQ ID NO: 63219 - protein, 36 aa, Homo sapiens
  Payload ID: 12617
  Gene Symbol: PLA2G4C
  Gene Name: phospholipase A2, group IVC (cytosolic, calcium-independent)
  ENSP ID: ENSP00000471328
MRTRPRPRLRLECNGMISAHWHLHLLSSSDSPPSAS

SEQ ID NO: 63220 - protein, 47 aa, Homo sapiens
  Payload ID: 12617
  Gene Symbol: PLA2G4C
  Gene Name: phospholipase A2, group IVC (cytosolic, calcium-independent)
  ENSP ID: ENSP00000471759
MKEQGLLDAVTYLAGVSGSTWAISSLYTNDGDMEALEADLKHRFTRQ

SEQ ID NO: 63221 - protein, 551 aa, Homo sapiens
  Payload ID: 12617
  Gene Symbol: PLA2G4C
  Gene Name: phospholipase A2, group IVC (cytosolic, calcium-independent)
  Uniprot ID: Q9UP65
  ENSP ID: ENSP00000472546
MRTRPRPRLRRTENFLTAVHHGKKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAGLYYPKDSARSCCLA

SEQ ID NO: 63222 - protein, 193 aa, Homo sapiens
  Payload ID: 12617
  Gene Symbol: PLA2G4C
  Gene Name: phospholipase A2, group IVC (cytosolic, calcium-independent)
  ENSP ID: ENSP00000472977
LPYPIFAAIDNDLQPSWQEARAPETWFEFTPHHAGFSALGAFVSITHFGSKFKKGRLVRTHPERDLTFLRDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSS

SEQ ID NO: 63223 - protein, 34 aa, Homo sapiens
  Payload ID: 12617
  Gene Symbol: PLA2G4C
  Gene Name: phospholipase A2, group IVC (cytosolic, calcium-independent)
  ENSP ID: ENSP00000473250
  MOD_RES (1)..(1): Any amino acid
XMKKPVEEGTLPYPIFAAIDNDLQPSWQEARAPG

SEQ ID NO: 63224 - protein, 818 aa, Homo sapiens
  Payload ID: 12618
  Gene Symbol: PLA2G4D
  Gene Name: phospholipase A2, group IVD (cytosolic)
  Uniprot ID: Q86XP0
  ENSP ID: ENSP00000290472
MESLSPGGPPGHPYQGEASTCWQLTVRVLEARNLRWADLLSEADPYVILQLSTAPGMKFKTKTLTDTSHPVWNEAFRFLIQSQVKNVLELSIYDEDSVTEDDICFKVLYDISEVLPGKLLRKTFSQSPQGEEELDVEFLMEETSDRPENLITNKVIVARELSCLDVHLDSTGSTAVVADQDKLELELVLKGSYEDTQTSFLGTASAFRFHYMAALETELSGRLRSSRSNGWNGDNSAGYLTVPLRPLTIGKEVTMDVPAPNAPGVRLQLKAEGCPEELAVHLGFNLCAEEQAFLSRRKQVVAKALKQALQLDRDLQEDEVPVVGIMATGGGARAMTSLYGHLLALQKLGLLDCVTYFSGISGSTWTMAHLYGDPEWSQRDLEGPIRYAREHLAKSKLEVFSPERLASYRRELELRAEQGHPTTFVDLWALVLESMLHGQVMDQKLSGQRAALERGQNPLPLYLSLNVKENNLETLDFKEWVEFSPYEVGFLKYGAFVPPELFGSEFFMGRLMRRIPEPRICFLEAIWSNIFSLNLLDAWYDLTSSGESWKQHIKDKTRSLEKEPLTTSGTSSRLEASWLQPGTALAQAFKGFLTGRPLHQRSPNFLQGLQLHQDYCSHKDFSTWADYQLDSMPSQLTPKEPRLCLVDAAYFINTSSPSMFRPGRRLDLILSFDYSLSAPFEALQQTELYCRARGLPFPRVEPSPQDQHQPRECHLFSDPACPEAPILLHFPLVNASFKDHSAPGVQRSPAELQGGQVDLTGATCPYTLSNMTYKEEDFERLLRLSDYNVQTSQGAILQALRTALKHRTLEARPPRAQT

SEQ ID NO: 63225 - protein, 868 aa, Homo sapiens
  Payload ID: 12619
  Gene Symbol: PLA2G4E
  Gene Name: phospholipase A2, group IVE
  Uniprot ID: Q3MJ16
  ENSP ID: ENSP00000382434
MSLQASEGCPGLGTNVFVPQSPQTDEEGSRSGRSFSEFEDTQDLDTPGLPPFCPMAPWGSEEGLSPCHLLTVRVIRMKNVRQADMLSQTDCFVSLWLPTASQKKLRTRTISNCPNPEWNESFNFQIQSRVKNVLELSVCDEDTVTPDDHLLTVLYDLTKLCFRKKTHVKFPLNPQGMEELEVEFLLEESPSPPETLVTNGVLVSRQVSCLEVHAQSRRRRKREKMKDLLVMVNESFENTQRVRPCLEPCCPTSACFQTAACFHYPKYFQSQVHVEVPKSHWSCGLCCRSRKKGPISQPLDCLSDGQVMTLPVGESYELHMKSTPCPETLDVRLGFSLCPAELEFLQKRKVVVAKALKQVLQLEEDLQEDEVPLIAIMATGGGTRSMTSMYGHLLGLQKLNLLDCASYITGLSGATWTMATLYRDPDWSSKNLEPAIFEARRHVVKDKLPSLFPDQLRKFQEELRQRSQEGYRVTFTDFWGLLIETCLGDERNECKLSDQRAALSCGQNPLPIYLTINVKDDVSNQDFREWFEFSPYEVGLQKYGAFIPSELFGSEFFMGRLVKRIPESRICYMLGLWSSIFSLNLLDAWNLSHTSEEFFHRWTREKVQDIEDEPILPEIPKCDANILETTVVIPGSWLSNSFREILTHRSFVSEFHNFLSGLQLHTNYLQNGQFSRWKDTVLDGFPNQLTESANHLCLLDTAFFVNSSYPPLLRPERKADLIIHLNYCAGSQTKPLKQTCEYCTVQNIPFPKYELPDENENLKECYLMENPQEPDAPIVTFFPLINDTFRKYKAPGVERSPEELEQGQVDIYGPKTPYATKELTYTEATFDKLVKLSEYNILNNKDTLLQALRLAVEKKKRLKGQCPS

SEQ ID NO: 63226 - protein, 60 aa, Homo sapiens
  Payload ID: 12620
  Gene Symbol: PLA2G4F
  Gene Name: phospholipase A2, group IVF
  ENSP ID: ENSP00000290497
MLWALWPRWLADKMLPLLGAVLLQKREKRGPLWRHWRCPKPTAMCNCGCPRRPQALPRLG

SEQ ID NO: 63227 - protein, 849 aa, Homo sapiens
  Payload ID: 12620
  Gene Symbol: PLA2G4F
  Gene Name: phospholipase A2, group IVF
  Uniprot ID: Q68DD2
  ENSP ID: ENSP00000380442
MLWALWPRWLADKMLPLLGAVLLQKREKRGPLWRHWRRETYPYYDLQVKVLRATNIRGTDLLSKADCYVQLWLPTASPSPAQTRIVANCSDPEWNETFHYQIHGAVKNVLELTLYDKDILGSDQLSLLLFDLRSLKCGQPHKHTFPLNHQDSQELQVEFVLEKSQVPASEVITNGVLVAHPCLRIQGTLRGDGTAPREEYGSRQLQLAVPGAYEKPQLLPLQPPTEPGLPPTFTFHVNPVLSSRLHVELMELLAAVQSGPSAELEAQTSKLGEGGILLSSLPLGQEEQCSVALGEGQEVALSMKVEMSSGDLDLRLGFDLSDGEQEFLDRRKQVVSKALQQVLGLSEALDSGQVPVVAVLGSGGGTRAMSSLYGSLAGLQELGLLDTVTYLSGVSGSTWCISTLYRDPAWSQVALQGPIERAQVHVCSSKMGALSTERLQYYTQELGVRERSGHSVSLIDLWGLLVEYLLYQEENPAKLSDQQEAVRQGQNPYPIYTSVNVRTNLSGEDFAEWCEFTPYEVGFPKYGAYVPTELFGSELFMGRLLQLQPEPRICYLQGMWGSAFATSLDEIFLKTAGSGLSFLEWYRGSVNITDDCQKPQLHNPSRLRTRLLTPQGPFSQAVLDIFTSRFTSAQSFNFTRGLCLHKDYVAGREFVAWKDTHPDAFPNQLTPMRDCLYLVDGGFAINSPFPLALLPQRAVDLILSFDYSLEAPFEVLKMTEKYCLDRGIPFPSIEVGPEDMEEARECYLFAKAEDPRSPIVLHFPLVNRTFRTHLAPGVERQTAEEKAFGDFVINRPDTPYGMMNFTYEPQDFYRLVALSRYNVLNNVETLKCALQLALDRHQARERAGA

SEQ ID NO: 63228 - protein, 296 aa, Homo sapiens
  Payload ID: 12620
  Gene Symbol: PLA2G4F
  Gene Name: phospholipase A2, group IVF
  ENSP ID: ENSP00000454330
MLWALWPRWLADKMLPLLGAVLLQKREKRGPLWRHWRRETYPYYDLQVKVLRATNIRGTDLLSKADCYVQLWLPTASPSPAQTRIVANCSDPEWNETFHYQIHGAVKNVLELTLYDKDILGSDQLSLLLFDLRSLKCGQPHKHTFPLNHQDSQELQVEFVLEKSQVPASEVITNGVLVAHPCLRIQGTLRGDGTAPREEYASHRARPPTHLYLPREPSAELQATRGADGAAGSCAEWPQRRVGGSDQQAGRGGHPALLSAPRPGGTVFCGPGGGPGGGSEHEGGNELRGPRPTPWL

SEQ ID NO: 63229 - protein, 86 aa, Homo sapiens
  Payload ID: 12620
  Gene Symbol: PLA2G4F
  Gene Name: phospholipase A2, group IVF
  ENSP ID: ENSP00000455037
VNITDDCQKPQLHNPSRLRTRLLTPQGPFSQAVLDIFTSRFTSAQSFNFTRGLCLHKDYVAGREFVAWKGLEDDREVLPGPRNPLP

SEQ ID NO: 63230 - protein, 70 aa, Homo sapiens
  Payload ID: 12620
  Gene Symbol: PLA2G4F
  Gene Name: phospholipase A2, group IVF
  ENSP ID: ENSP00000455513
MLWALWPRWLADKMLPLLGAVLLQKREKRGPLWRHWRRETYPYYDLQVKVLRATNIRGTDLPSPRKPFQQ

SEQ ID NO: 63231 - protein, 119 aa, Homo sapiens
  Payload ID: 12620
  Gene Symbol: PLA2G4F
  Gene Name: phospholipase A2, group IVF
  ENSP ID: ENSP00000456697
MLWALWPRWLADKMLPLLGAVLLQKREKRGPLWRHWRRETYPYYDLQVKVLRATNIRGTDLLSKADCYVQLWLPTASPSPAQTRIVANCSDPEWNLFWRRARCLHLKSSPTGFWWLTPV

SEQ ID NO: 63232 - protein, 138 aa, Homo sapiens
  Payload ID: 12621
  Gene Symbol: PLA2G5
  Gene Name: phospholipase A2, group V
  Uniprot ID: P39877
  ENSP ID: ENSP00000364249
MKGLLPLAWFLACSVPAVQGGLLDLKSMIEKVTGKNALTNYGFYGCYCGWGGRGTPKDGTDWCCWAHDHCYGRLEEKGCNIRTQSYKYRFAWGVVTCEPGPFCHVNLCACDRKLVYCLKRNLRSYNPQYQYFPNILCS

SEQ ID NO: 63233 - protein, 806 aa, Homo sapiens
  Payload ID: 12622
  Gene Symbol: PLA2G6
  Gene Name: phospholipase A2, group VI (cytosolic, calcium-independent)
  Uniprot ID: O60733
  ENSP ID: ENSP00000333142
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 63234 - protein, 752 aa, Homo sapiens
  Payload ID: 12622
  Gene Symbol: PLA2G6
  Gene Name: phospholipase A2, group VI (cytosolic, calcium-independent)
  Uniprot ID: O60733
  ENSP ID: ENSP00000335149
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRQLQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 63235 - protein, 752 aa, Homo sapiens; identical to SEQ ID NO: 63234
  Payload ID: 12622
  Gene Symbol: PLA2G6
  Gene Name: phospholipase A2, group VI (cytosolic, calcium-independent)
  Uniprot ID: O60733
  ENSP ID: ENSP00000386100

SEQ ID NO: 63236 - protein, 124 aa, Homo sapiens
  Payload ID: 12622
  Gene Symbol: PLA2G6
  Gene Name: phospholipase A2, group VI (cytosolic, calcium-independent)
  ENSP ID: ENSP00000392968
  MOD_RES (1)..(1): Any amino acid
XARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLGSHPSQAGWWAWGAASDG

SEQ ID NO: 63237 - protein, 99 aa, Homo sapiens
  Payload ID: 12622
  Gene Symbol: PLA2G6
  Gene Name: phospholipase A2, group VI (cytosolic, calcium-independent)
  ENSP ID: ENSP00000393361
MQFFGRLVNTFSGVTNLFSNPFRVKEVAVADYTSSDRVREEGQLILFQNTPNRTWDCVLVNPRNSQSGFRRLGSSPCVLSPMRLLLVLLVCPSSPVTAT

SEQ ID NO: 63238 - protein, 79 aa, Homo sapiens
  Payload ID: 12622
  Gene Symbol: PLA2G6
  Gene Name: phospholipase A2, group VI (cytosolic, calcium-independent)
  ENSP ID: ENSP00000393761
MQFFGRLVNTFSGVTNLFSNPFRVKEVAVADYTSSDRVREEGQLILFQNTPNRTWDCVLVNPRNSQSGFRLFQLELEAD

SEQ ID NO: 63239 - protein, 166 aa, Homo sapiens
  Payload ID: 12622
  Gene Symbol: PLA2G6
  Gene Name: phospholipase A2, group VI (cytosolic, calcium-independent)
  ENSP ID: ENSP00000395464
MQFFGRLVNTFSGVTNLFSNPFRVKEVAVADYTSSDRVREEGQLILFQNTPNRTWDCVLVNPRNSQSGFRCANCAENEEGCTPLHLACRKGDGEILVELVQYCHTQMDVTDYKGETVFHYAVQGDNSQVLQLLGRNAVAGLNQVNNQGLTPLHLACQLGKQEMVRV

SEQ ID NO: 63240 - protein, 151 aa, Homo sapiens
  Payload ID: 12622
  Gene Symbol: PLA2G6
  Gene Name: phospholipase A2, group VI (cytosolic, calcium-independent)
  ENSP ID: ENSP00000401242
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISSLEGTQWLA

SEQ ID NO: 63241 - protein, 99 aa, Homo sapiens; identical to SEQ ID NO: 63237
  Payload ID: 12622
  Gene Symbol: PLA2G6
  Gene Name: phospholipase A2, group VI (cytosolic, calcium-independent)
  ENSP ID: ENSP00000404974

SEQ ID NO: 63242 - protein, 226 aa, Homo sapiens
  Payload ID: 12622
  Gene Symbol: PLA2G6
  Gene Name: phospholipase A2, group VI (cytosolic, calcium-independent)
  ENSP ID: ENSP00000407106
MDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLGSHPSQAGWWAWGAASDGTTGSHAHLTGPEASVHPGLHEGREADMQNLSP

SEQ ID NO: 63243 - protein, 229 aa, Homo sapiens
  Payload ID: 12622
  Gene Symbol: PLA2G6
  Gene Name: phospholipase A2, group VI (cytosolic, calcium-independent)
  ENSP ID: ENSP00000407743
  MOD_RES (1)..(1): Any amino acid
XASITAVSSAVPIARRTRRAAHPCTWPAARVMGRSWWSWCSTATLRWMSPTTRERPSSIMLSRVTILRCCRCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAE

SEQ ID NO: 63244 - protein, 157 aa, Homo sapiens
  Payload ID: 12622
  Gene Symbol: PLA2G6
  Gene Name: phospholipase A2, group VI (cytosolic, calcium-independent)
  ENSP ID: ENSP00000408298
  MOD_RES (1)..(1): Any amino acid
XGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSMESRTVAQAGVQWRDLGSPQPPPPRFKRFSCLSLPSSWDCRKTTWR

SEQ ID NO: 63245 - protein, 197 aa, Homo sapiens
  Payload ID: 12622
  Gene Symbol: PLA2G6
  Gene Name: phospholipase A2, group VI (cytosolic, calcium-independent)
  ENSP ID: ENSP00000412629
  MOD_RES (1)..(1): Any amino acid
XLVELVQYCHTQMDVTDYKGETVFHYAVQGDNSQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMI

SEQ ID NO: 63246 - protein, 168 aa, Homo sapiens
  Payload ID: 12622
  Gene Symbol: PLA2G6
  Gene Name: phospholipase A2, group VI (cytosolic, calcium-independent)
  ENSP ID: ENSP00000413145
  MOD_RES (1)..(1): Any amino acid
XDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKLDQSDTPPALPERACFAGMVRGEAHLSRTEGDADRDTV

SEQ ID NO: 63247 - protein, 99 aa, Homo sapiens; identical to SEQ ID NO: 63237
  Payload ID: 12622
  Gene Symbol: PLA2G6
  Gene Name: phospholipase A2, group VI (cytosolic, calcium-independent)
  ENSP ID: ENSP00000413597

SEQ ID NO: 63248 - protein, 120 aa, Homo sapiens
  Payload ID: 12622
  Gene Symbol: PLA2G6
  Gene Name: phospholipase A2, group VI (cytosolic, calcium-independent)
  ENSP ID: ENSP00000472058
MDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAE

SEQ ID NO: 63249 - protein, 50 aa, Homo sapiens
  Payload ID: 12622
  Gene Symbol: PLA2G6
  Gene Name: phospholipase A2, group VI (cytosolic, calcium-independent)
  ENSP ID: ENSP00000473160
MQFFGRLVNTFSGVTNLFSNPFRVKEVAVADYTSSDRVREEGQLILFQNT

SEQ ID NO: 63250 - protein, 441 aa, Homo sapiens
  Payload ID: 12623
  Gene Symbol: PLA2G7
  Gene Name: phospholipase A2, group VII (platelet-activating factor acetylhydrolase, plasma)
  Uniprot ID: Q13093
  ENSP ID: ENSP00000274793
MVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKDSIDREKIAVIGHSFGGATVIQTLSEDQRFRCGIALDAWMFPLGDEVYSRIPQPLFFINSEYFQYPANIIKMKKCYSPDKERKMITIRGSVHQNFADFTFATGKIIGHMLKLKGDIDSNVAIDLSNKASLAFLQKHLGLHKDFDQWDCLIEGDDENLIPGTNINTTNQHIMLQNSSGIEKYN

SEQ ID NO: 63251 - protein, 441 aa, Homo sapiens; identical to SEQ ID NO: 63250
  Payload ID: 12623
  Gene Symbol: PLA2G7
  Gene Name: phospholipase A2, group VII (platelet-activating factor acetylhydrolase, plasma)
  Uniprot ID: Q13093
  ENSP ID: ENSP00000445666

SEQ ID NO: 63252 - protein, 165 aa, Homo sapiens
  Payload ID: 12624
  Gene Symbol: PLA2G10
  Gene Name: phospholipase A2, group X
  Uniprot ID: O15496
  ENSP ID: ENSP00000393847
MGPLPVCLPIMLLLLLPSLLLLLLLPGPGSGEASRILRVHRRGILELAGTVGCVGPRTPIAYMKYGCFCGLGGHGQPRDAIDWCCHGHDCCYTRAEEAGCSPKTERYSWQCVNQSVLCGPAENKCQELLCKCDQEIANCLAQTEYNLKYLFYPQFLCEPDSPKCD

SEQ ID NO: 63253 - protein, 130 aa, Homo sapiens
  Payload ID: 12624
  Gene Symbol: PLA2G10
  Gene Name: phospholipase A2, group X
  ENSP ID: ENSP00000456433
MGPLPVCLPIMLLLLLPSLLLLLLLPGPGSGEASRILRVHRRGILELAGTVGCVGPRTPIAYMKYGCFCGLGGHGQPRDAIDWCCHGHDCCYTRAEEAGCSPKTERYSWQCVNQSVLCVLLCHPGWSAVV

SEQ ID NO: 63254 - protein, 165 aa, Homo sapiens; identical to SEQ ID NO: 63252
  Payload ID: 12624
  Gene Symbol: PLA2G10
  Gene Name: phospholipase A2, group X
  Uniprot ID: O15496
  ENSP ID: ENSP00000479397

SEQ ID NO: 63255 - protein, 130 aa, Homo sapiens; identical to SEQ ID NO: 63253
  Payload ID: 12624
  Gene Symbol: PLA2G10
  Gene Name: phospholipase A2, group X
  ENSP ID: ENSP00000488697

SEQ ID NO: 63256 - protein, 189 aa, Homo sapiens
  Payload ID: 12625
  Gene Symbol: PLA2G12A
  Gene Name: phospholipase A2, group XIIA
  Uniprot ID: Q9BZM1
  ENSP ID: ENSP00000243501
MALLSRPALTLLLLLMAAVVRCQEQAQTTDWRATLKTIRNGVHKIDTYLNAALDLLGGEDGLCQYKCSDGSKPFPRYGYKPSPPNGCGSPLFGVHLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 63257 - protein, 70 aa, Homo sapiens
  Payload ID: 12625
  Gene Symbol: PLA2G12A
  Gene Name: phospholipase A2, group XIIA
  ENSP ID: ENSP00000424021
MALLSRPALTLLLLLMAAVVRCQEQAQTTDWRATLKTIRNGVHKIDTYLNAALDLLGGEDGLCQYKCSDA

SEQ ID NO: 63258 - protein, 187 aa, Homo sapiens
  Payload ID: 12625
  Gene Symbol: PLA2G12A
  Gene Name: phospholipase A2, group XIIA
  ENSP ID: ENSP00000425274
MALLSRPALTLLLLLMAAVVRCQEQAQTTDWRATLKTIRNGVHKIDTYLNAALDLLGGEDGLCQYKCSDGSKPFPRYGYKPSPPNGCGSPLFGLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 63259 - protein, 195 aa, Homo sapiens
  Payload ID: 12626
  Gene Symbol: PLA2G12B
  Gene Name: phospholipase A2, group XIIB
  Uniprot ID: Q9BX93
  ENSP ID: ENSP00000362123
MKLASGFLVLWLSLGGGLAQSDTSPDTEESYSDWGLRHLRGSFESVNSYFDSFLELLGGKNGVCQYRCRYGKAPMPRPGYKPQEPNGCGSYFLGLKVPESMDLGIPAMTKCCNQLDVCYDTCGANKYRCDAKFRWCLHSICSDLKRSLGFVSKVEAACDSLVDTVFNTVWTLGCRPFMNSQRAACICAEEEKEEL

SEQ ID NO: 63260 - protein, 412 aa, Homo sapiens
  Payload ID: 12627
  Gene Symbol: PLA2G15
  Gene Name: phospholipase A2, group XV
  Uniprot ID: Q8NCC3
  ENSP ID: ENSP00000219345
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPNENGPYFLALREMIEEMYQLYGGPVVLVAHSMGNMYTLYFLQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 63261 - protein, 212 aa, Homo sapiens
  Payload ID: 12627
  Gene Symbol: PLA2G15
  Gene Name: phospholipase A2, group XV
  ENSP ID: ENSP00000393610
MGLHLRPYRVGLLPDGLLFLLLLLMLLADPALPAGRHPPVVLGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 63262 - protein, 318 aa, Homo sapiens
  Payload ID: 12627
  Gene Symbol: PLA2G15
  Gene Name: phospholipase A2, group XV
  Uniprot ID: Q8NCC3
  ENSP ID: ENSP00000394197
MGLHLRPYRVGLLPDGLLFLLLLLMLLADPALPAGRHPPVVLGWFTTKHPGPPSFLMVWMYVSLALGRPSHWSSWTPAKAAWVPISTPWWRALWAGATHGVRMSEGLPMTGAEPQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 63263 - protein, 163 aa, Homo sapiens
  Payload ID: 12627
  Gene Symbol: PLA2G15
  Gene Name: phospholipase A2, group XV
  ENSP ID: ENSP00000454227
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVDENGPYFLALREMIEEMYQLYGGPVVLVA

SEQ ID NO: 63264 - protein, 298 aa, Homo sapiens
  Payload ID: 12627
  Gene Symbol: PLA2G15
  Gene Name: phospholipase A2, group XV
  ENSP ID: ENSP00000454557
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPTQWFRLQDPSHLTPAWLWPADENGPYFLALREMIEEMYQLYGGPVVLVAHSMGNMYTLYFLQRQPQAWKDKYIRAFVSLGAPWGGVAKTLRVLASGDNNRIPVIGPLKIREQQRSAVSTSWLLPYNYTWSP

SEQ ID NO: 63265 - protein, 242 aa, Homo sapiens
  Payload ID: 12627
  Gene Symbol: PLA2G15
  Gene Name: phospholipase A2, group XV
  ENSP ID: ENSP00000455461
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLECSGAISAHYTSASQAQALLLPQTPDNWDYRLVYNKTSRATQFPDGVDVRVPGFGKTFSLEFLDPSKSSVGSYFHTMVESLVGWGYTRGEDVRGAPYDWRRAPTAAAGLEGQVYPGLRVTGCALGGRGQDPARPGFRRQQPDPSHR

SEQ ID NO: 63266 - protein, 236 aa, Homo sapiens
  Payload ID: 12627
  Gene Symbol: PLA2G15
  Gene Name: phospholipase A2, group XV
  ENSP ID: ENSP00000457034
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPTAAAGLEGQVYPGLRVTGCALGGRGQDPARPGFRRQQPDPSHRAPEDPGAAAVSCLHQLAAALQLHMVT

SEQ ID NO: 63267 - protein, 86 aa, Homo sapiens
  Payload ID: 12627
  Gene Symbol: PLA2G15
  Gene Name: phospholipase A2, group XV
  ENSP ID: ENSP00000457049
MGLHLRPYRVGLLPDGLLFLLLLLMLLADPALPAGRHPPVVLVEMGFHHIGQAGLELLTASDPLTSASQSAGITGMSPCALPRSPW

SEQ ID NO: 63268 - protein, 162 aa, Homo sapiens
  Payload ID: 12628
  Gene Symbol: PLA2G16
  Gene Name: phospholipase A2, group XVI
  Uniprot ID: P53816
  ENSP ID: ENSP00000320337
MRAPIPEPKPGDLIEIFRPFYRHWAIYVGDGYVVHLAPPSEVAGAGAASVMSALTDKAIVKKELLYDVAGSDKYQVNNKHDDKYSPLPCSKIIQRAEELVGQEVLYKLTSENCEHFVNELRYGVARSDQVRDVIIAASVAGMGLAAMSLIGVMFSRNKRQKQ

SEQ ID NO: 63269 - protein, 162 aa, Homo sapiens; identical to SEQ ID NO: 63268
  Payload ID: 12628
  Gene Symbol: PLA2G16
  Gene Name: phospholipase A2, group XVI
  Uniprot ID: P53816
  ENSP ID: ENSP00000389124

SEQ ID NO: 63270 - protein, 27 aa, Homo sapiens
  Payload ID: 12628
  Gene Symbol: PLA2G16
  Gene Name: phospholipase A2, group XVI
  ENSP ID: ENSP00000442576
MSALTDKAIVKKELLYDVAGSDKYQVN

SEQ ID NO: 63271 - protein, 795 aa, Homo sapiens
  Payload ID: 12629
  Gene Symbol: PLAA
  Gene Name: phospholipase A2-activating protein
  Uniprot ID: Q9Y263
  ENSP ID: ENSP00000380460
MTSGATRYRLSCSLRGHELDVRGLVCCAYPPGAFVSVSRDRTTRLWAPDSPNRSFTEMHCMSGHSNFVSCVCIIPSSDIYPHGLIATGGNDHNICIFSLDSPMPLYILKGHKNTVCSLSSGKFGTLLSGSWDTTAKVWLNDKCMMTLQGHTAAVWAVKILPEQGLMLTGSADKTVKLWKAGRCERTFSGHEDCVRGLAILSETEFLSCANDASIRRWQITGECLEVYYGHTNYIYSISVFPNCRDFVTTAEDRSLRIWKHGECAQTIRLPAQSIWCCCVLDNGDIVVGASDGIIRVFTESEDRTASAEEIKAFEKELSHATIDSKTGDLGDINAEQLPGREHLNEPGTREGQTRLIRDGEKVEAYQWSVSEGRWIKIGDVVGSSGANQQTSGKVLYEGKEFDYVFSIDVNEGGPSYKLPYNTSDDPWLTAYNFLQKNDLNPMFLDQVAKFIIDNTKGQMLGLGNPSFSDPFTGGGRYVPGSSGSSNTLPTADPFTGAGRYVPGSASMGTTMAGVDPFTGNSAYRSAASKTMNIYFPKKEAVTFDQANPTQILGKLKELNGTAPEEKKLTEDDLILLEKILSLICNSSSEKPTVQQLQILWKAINCPEDIVFPALDILRLSIKHPSVNENFCNEKEGAQFSSHLINLLNPKGKPANQLLALRTFCNCFVGQAGQKLMMSQRESLMSHAIELKSGSNKNIHIALATLALNYSVCFHKDHNIEGKAQCLSLISTILEVVQDLEATFRLLVALGTLISDDSNAVQLAKSLGVDSQIKKYSSVSEPAKVSECCRFILNLL

SEQ ID NO: 63272 - protein, 244 aa, Homo sapiens
  Payload ID: 12629
  Gene Symbol: PLAA
  Gene Name: phospholipase A2-activating protein
  ENSP ID: ENSP00000428111
  MOD_RES (1)..(1): Any amino acid
XRGLVCCAYPPGAFVSVSRDRTTRLWAPDRSFTEMHCMSGHSNFVSCVCIIPSSDIYPHGLIATGGNDHNICIFSLDSPMPLYILKGHKNTVCSLSSGKFGTLLSGSWDTTAKVWLNDKCMMTLQGHTAAVWAVKILPEQGLMLTGSADKTVKLWKAGRCERTFSGHEDCVRGLAILSETEFLSCANDASIRRWQITGECLEVYYGHTNYIYSISVFPNCRDFVTTAEDRSLRIWKHGECAQTI

SEQ ID NO: 63273 - protein, 609 aa, Homo sapiens
  Payload ID: 12629
  Gene Symbol: PLAA
  Gene Name: phospholipase A2-activating protein
  ENSP ID: ENSP00000429372
MTSGATRYRLSCSLRGHELDVRGLVCCAYPPGAFVSVSRDRTTRLWAPDSPNRSFTEMHCMSGHSNFVSCVCIIPSSDIYPHGLIATGGNDHNICIFSLDSPMPLYILKGHKNTVCSLSSGKFGTLLSGSWDTTAKVWLNDKCMMTLQGHTAAVWAVKILPEQGLMLTGSADKTVKLWKAGRCERTFSGHEDCVRGLAILSETEFLSCANDASIRRWQITGECLEVYYGHTNYIYSISVFPNCRDFVTTAEDRSLRIWKHGECAQTIRLPAQSIWCCCVLDNGDIVVGASDGIIRVFTESEDRTASAEEIKAFEKELSHATIDSKTGDLGDINAEQLPGREHLNEPGTREGQTRLIRDGEKVEAYQWSVSEGRWIKIGDVVGSSGANQQTSGKVLYEGKEFDYVFSIDVNEGGPSYKLPYNTSDDPWLTAYNFLQKNDLNPMFLDQVAKFIIDNTKGQMLGLGNPSFSDPFTGGGRYVPGSSGSSNTLPTADPFTGAGRYVPGSASMGTTMAGVDPFTGNSAYRSAASKTMNIYFPKKEAVTFDQANPTQILGKLKELNGTAPEEKKLTEDDLILLEKILSLICNSSSEKPTVQQLQILWKAINCPEGK

SEQ ID NO: 63274 - protein, 290 aa, Homo sapiens
  Payload ID: 12629
  Gene Symbol: PLAA
  Gene Name: phospholipase A2-activating protein
  ENSP ID: ENSP00000430447
  MOD_RES (1)..(1): Any amino acid
XLGDINAEQLPGREHLNEPGTREGQTRLIRDGEKVEAYQWSVSEGRWIKIGDVVGSSGANQQTSGKVLYEGKEFDYVFSIDVNEGGPSYKLPYNTSDDPWLTAYNFLQKNDLNPMFLDQVAKFIIDNTKGQMLGLGNPSFSDPFTGGGRYVPGSSGSSNTLPTADPFTGAGRYVPGSASMGTTMAGVDPFTGNSAYRSAASKTMNIYFPKKEAVTFDQANPTQILDIVFPALDILRLSIKHPSVNENFCNEKEGAQFSSHLINLLNPKGKPANQLLALRTFCNCFVGQAG

SEQ ID NO: 63275 - protein, 136 aa, Homo sapiens
  Payload ID: 12629
  Gene Symbol: PLAA
  Gene Name: phospholipase A2-activating protein
  ENSP ID: ENSP00000430734
  MOD_RES (1)..(1): Any amino acid
XIDNTKGQMLGLGNPSFSDPFTGAGRYVPGSASMGTTMAGVDPFTGNSAYRSAASKTMNIYFPKKEAVTFDQANPTQILGKLKELNGTAPEEKKLTEDDLILLEKILSLICNSSSEKPTVQQLQILWKAINCPEGK

SEQ ID NO: 63276 - protein, 553 aa, Homo sapiens
  Payload ID: 12630
  Gene Symbol: PLBD1
  Gene Name: phospholipase B domain containing 1
  Uniprot ID: Q6P4A8
  ENSP ID: ENSP00000240617
MTRGGPGGRPGLPQPPPLLLLLLLLPLLLVTAEPPKPAGVYYATAYWMPAEKTVQVKNVMDKNGDAYGFYNNSVKTTGWGILEIRAGYGSQTLSNEIIMFVAGFLEGYLTAPHMNDHYTNLYPQLITKPSIMDKVQDFMEKQDKWTRKNIKEYKTDSFWRHTGYVMAQIDGLYVGAKKRAILEGTKPMTLFQIQFLNSVGDLLDLIPSLSPTKNGSLKVFKRWDMGHCSALIKVLPGFENILFAHSSWYTYAAMLRIYKHWDFNVIDKDTSSSRLSFSSYPGFLESLDDFYILSSGLILLQTTNSVFNKTLLKQVIPETLLSWQRVRVANMMADSGKRWADIFSKYNSGTYNNQYMVLDLKKVKLNHSLDKGTLYIVEQIPTYVEYSEQTDVLRKGYWPSYNVPFHEKIYNWSGYPLLVQKLGLDYSYDLAPRAKIFRRDQGKVTDTASMKYIMRYNNYKKDPYSRGDPCNTICCREDLNSPNPSPGGCYDTKVADIYLASQYTSYAISGPTVQGGLPVFRWDRFNKTLHQGMPEVYNFDFITMKPILKLDIK

SEQ ID NO: 63277 - protein, 144 aa, Homo sapiens
  Payload ID: 12630
  Gene Symbol: PLBD1
  Gene Name: phospholipase B domain containing 1
  ENSP ID: ENSP00000438367
MPAEKTVQVKNVMDKNGDAYGFYNNSVKTTGWGILEIRAGYGSQTLSNEIIMFVAGFLEGYLTAPHMNDHYTNLYPQLITKPSIMDKVQDFMEKQDKWTRKNIKEYKTDSFWRHTGYVMAQIDGLYVGAKKRAILEGTKPMTLF

SEQ ID NO: 63278 - protein, 40 aa, Homo sapiens
  Payload ID: 12630
  Gene Symbol: PLBD1
  Gene Name: phospholipase B domain containing 1
  ENSP ID: ENSP00000441278
MTRGGPGGRPGLPQPPPLLLLLLLLPLLLVTAEPPKPADT

SEQ ID NO: 63279 - protein, 589 aa, Homo sapiens
  Payload ID: 12631
  Gene Symbol: PLBD2
  Gene Name: phospholipase B domain containing 2
  Uniprot ID: Q8NHP8
  ENSP ID: ENSP00000280800
MVGQMYCYPGSHLARALTRALALALVLALLVGPFLSGLAGAIPAPGGRWARDGQVPPASRSRSVLLDVSAGQLLMVDGRHPDAVAWANLTNAIRETGWAFLELGTSGQYNDSLQAYAAGVVEAAVSEELIYMHWMNTVVNYCGPFEYEVGYCERLKSFLEANLEWMQEEMESNPDSPYWHQVRLTLLQLKGLEDSYEGRVSFPAGKFTIKPLGFLLLQLSGDLEDLELALNKTKIKPSLGSGSCSALIKLLPGQSDLLVAHNTWNNYQHMLRVIKKYWLQFREGPWGDYPLVPGNKLVFSSYPGTIFSCDDFYILGSGLVTLETTIGNKNPALWKYVRPRGCVLEWVRNIVANRLASDGATWADIFKRFNSGTYNNQWMIVDYKAFIPGGPSPGSRVLTILEQIPGMVVVADKTSELYQKTYWASYNIPSFETVFNASGLQALVAQYGDWFSYDGSPRAQIFRRNQSLVQDMDSMVRLMRYNDFLHDPLSLCKACNPQPNGENAISARSDLNPANGSYPFQALRQRSHGGIDVKVTSMSLARILSLLAASGPTWDQVPPFQWSTSPFSGLLHMGQPDLWKFAPVKVSWD

SEQ ID NO: 63280 - protein, 557 aa, Homo sapiens
  Payload ID: 12631
  Gene Symbol: PLBD2
  Gene Name: phospholipase B domain containing 2
  Uniprot ID: Q8NHP8
  ENSP ID: ENSP00000443463
MVGQMYCYPGSHLARALTRALALALVLALLVGPFLSGLAGAIPAPGGRWARDGQVPPASRSRSVLLDVSAGQLLMVDGRHPDAVAWANLTNAIRETGWAFLELGTSGQYNDSLQAYAAGVVEAAVSEELIYMHWMNTVVNYCGPFEYEVGYCERLKSFLEANLEWMQEEMESNPDSPYWHQVRLTLLQLKGLEDSYEGRVSFPAGKFTIKPLGFLLLQLSGDLEDLELALNKTKIKPSLGSGSCSALIKLLPGQSDLLVAHNTWNNYQHMLRVIKKYWLQFREGPWGDYPLVPGNKLVFSSYPGTIFSCDDFYILGSGLVTLETTIGNKNPALWKYVRPRGCVLEWVRNIVANRLASDGATWADIFKRFNSGTGMVVVADKTSELYQKTYWASYNIPSFETVFNASGLQALVAQYGDWFSYDGSPRAQIFRRNQSLVQDMDSMVRLMRYNDFLHDPLSLCKACNPQPNGENAISARSDLNPANGSYPFQALRQRSHGGIDVKVTSMSLARILSLLAASGPTWDQVPPFQWSTSPFSGLLHMGQPDLWKFAPVKVSWD

SEQ ID NO: 63281 - protein, 52 aa, Homo sapiens
  Payload ID: 12631
  Gene Symbol: PLBD2
  Gene Name: phospholipase B domain containing 2
  ENSP ID: ENSP00000450343
DGQVPPASRSRSVLLDVSAGQLLMVDGRHPDAVAWANLTNAIRETGSSTCTG

SEQ ID NO: 63282 - protein, 1458 aa, Homo sapiens
  Payload ID: 12632
  Gene Symbol: PLB1
  Gene Name: phospholipase B1
  Uniprot ID: Q6P1J6
  ENSP ID: ENSP00000330442
MGLRPGIFLLELLLLLGQGTPQIHTSPRKSTLEGQLWPETLKNSPFPCNPNKLGVNMPSKSVHSLKPSDIKFVAAIGNLEIPPDPGTGDLEKQDWTERPQQVCMGVMTVLSDIIRYFSPSVPMPVCHTGKRVIPHDGAEDLWIQAQELVRNMKENLQLDFQFDWKLINVFFSNASQCYLCPSAQQNGLAAGGVDELMGVLDYLQQEVPRAFVNLVDLSEVAEVSRQYHGTWLSPAPEPCNCSEETTRLAKVVMQWSYQEAWNSLLASSRYSEQESFTVVFQPFFYETTPSLHSEDPRLQDSTTLAWHLWNRMMEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVHYSPQNFTDNIGKALDILHAEVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYSAGGDGSLENVTTLPNILREFNRNLTGYAVGTGDANDTNAFLNQAVPGAKAEDLMSQVQTLMQKMKDDHRVNFHEDWKVITVLIGGSDLCDYCTDSNLYSAANFVHHLRNALDVLHREVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 63283 - protein, 1446 aa, Homo sapiens
  Payload ID: 12632
  Gene Symbol: PLB1
  Gene Name: phospholipase B1
  ENSP ID: ENSP00000384187
  MOD_RES (1)..(1): Any amino acid
XLRPGIFLLELLLLLGQGTPQIHTSPRKSTLEGQLWPETLKNSPFPCNPNKLGVNMPSKSVHSLKPSDIKFVAAIGNLEIPPDPGTGDLEKQDWTERPQQVCMGVMTVLSDIIRYFSPSVPMPVCHTGKRVIPHDGAEDLWIQAQELVRNMKENLQLDFQFDWKLINVFFSNASQCYLCPSAQQAPSLSTVLLSQNGLAAGGVDELMGVLDYLQQEVPRAFVNLVDLSEVAEVSRQYHGTWLSPAPEPCNCSEETTRLAKVVMQWSYQEAWNSLLASSRYSEQESFTVVFQPFFYETTPSLHSEDPRLQDSTTLAWHLWNRMMEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYSAGGDGSLENVTTLPNILREFNRNLTGYAVGTGDANDTNAFLNQAVPGAKAEDLMSQVQTLMQKMKDDHRVNFHEDWKVITVLIGGSDLCDYCTDSNLYSAANFVHHLRNALDVLHREVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 63284 - protein, 277 aa, Homo sapiens
  Payload ID: 12632
  Gene Symbol: PLB1
  Gene Name: phospholipase B1
  ENSP ID: ENSP00000391810
FFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPVGPRPTPWGPEKEGGPLGHGICSAHPTGPGHPL

SEQ ID NO: 63285 - protein, 510 aa, Homo sapiens
  Payload ID: 12632
  Gene Symbol: PLB1
  Gene Name: phospholipase B1
  ENSP ID: ENSP00000392493
QLCPGWLGPTSTSAVQLFLLGEMEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVHYSPQNFTDNIGKALDILHAEVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYRESKPGFLSDSWVSKSNRKCTRKAPNP

SEQ ID NO: 63286 - protein, 161 aa, Homo sapiens
  Payload ID: 12632
  Gene Symbol: PLB1
  Gene Name: phospholipase B1
  ENSP ID: ENSP00000399712
  MOD_RES (1)..(1): Any amino acid
XNNCTCLRHSQSSLEKQELKKVNWNLQHGISSFSYWHQYTQREDFAVVVQPFFQNTLTPLNERGDTDLTFFSEDCFHFSDRGHAEMAIALWNNMESPYLYTLRNSRLLPDQAEEAPEVLYWAVPVAAGVGLVVGIIGTVVWRCRRGGRREDPPMSLRTVAL

SEQ ID NO: 63287 - protein, 62 aa, Homo sapiens
  Payload ID: 12632
  Gene Symbol: PLB1
  Gene Name: phospholipase B1
  ENSP ID: ENSP00000404723
  MOD_RES (1)..(1): Any amino acid
XFVHHLRNALDVLHREVPRVLVNLVDFLNPTIMRQVFLGNPDKCPVQQASLNHLEAKQRPWT

SEQ ID NO: 63288 - protein, 183 aa, Homo sapiens
  Payload ID: 12632
  Gene Symbol: PLB1
  Gene Name: phospholipase B1
  ENSP ID: ENSP00000407076
MPSKSVHSLKPSDIKFVAAIGNLEIPPDPGTGDLEKQDWTERPQQVCMGVMTVLSDIIRYFSPSVPMPVCHTGKRVIPHDGAEDLWIQAQELVRNMKENLQLDFQFDWKLINVFFSNASQCYLCPSAQQAPSLSTVLLSQNGLAAGGVDELMGVLDYLQQEVPRAFVNLVDLSEVAEVSRQYH

SEQ ID NO: 63289 - protein, 1447 aa, Homo sapiens
  Payload ID: 12632
  Gene Symbol: PLB1
  Gene Name: phospholipase B1
  Uniprot ID: Q6P1J6
  ENSP ID: ENSP00000416440
MGLRPGIFLLELLLLLGQGTPQIHTSPRKSTLEGQLWPETLKNSPFPCNPNKLGVNMPSKSVHSLKPSDIKFVAAIGNLEIPPDPGTGDLEKQDWTERPQQVCMGVMTVLSDIIRYFSPSVPMPVCHTGKRVIPHDGAEDLWIQAQELVRNMKENLQLDFQFDWKLINVFFSNASQCYLCPSAQQAPSLSTVLLSQNGLAAGGVDELMGVLDYLQQEVPRAFVNLVDLSEVAEVSRQYHGTWLSPAPEPCNCSEETTRLAKVVMQWSYQEAWNSLLASSRYSEQESFTVVFQPFFYETTPSLHSEDPRLQDSTTLAWHLWNRMMEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYSAGGDGSLENVTTLPNILREFNRNLTGYAVGTGDANDTNAFLNQAVPGAKAEDLMSQVQTLMQKMKDDHRVNFHEDWKVITVLIGGSDLCDYCTDSNLYSAANFVHHLRNALDVLHREVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 63290 - protein, 1216 aa, Homo sapiens
  Payload ID: 12633
  Gene Symbol: PLCB1
  Gene Name: phospholipase C, beta 1 (phosphoinositide-specific)
  Uniprot ID: Q9NQ66
  ENSP ID: ENSP00000338185
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHGSAPLSLSSDPGKVNHKTPSSEELGGDIPGKEFDTPL

SEQ ID NO: 63291 - protein, 1173 aa, Homo sapiens
  Payload ID: 12633
  Gene Symbol: PLCB1
  Gene Name: phospholipase C, beta 1 (phosphoinositide-specific)
  Uniprot ID: Q9NQ66
  ENSP ID: ENSP00000367904
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKGEGSSSFLSETCHEDPSVSPNFTPPNPQALKW

SEQ ID NO: 63292 - protein, 1173 aa, Homo sapiens; identical to SEQ ID NO: 63291
  Payload ID: 12633
  Gene Symbol: PLCB1
  Gene Name: phospholipase C, beta 1 (phosphoinositide-specific)
  Uniprot ID: Q9NQ66
  ENSP ID: ENSP00000367908

SEQ ID NO: 63293 - protein, 205 aa, Homo sapiens
  Payload ID: 12633
  Gene Symbol: PLCB1
  Gene Name: phospholipase C, beta 1 (phosphoinositide-specific)
  ENSP ID: ENSP00000384001
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRVSMCVML

SEQ ID NO: 63294 - protein, 41 aa, Homo sapiens
  Payload ID: 12633
  Gene Symbol: PLCB1
  Gene Name: phospholipase C, beta 1 (phosphoinositide-specific)
  ENSP ID: ENSP00000389911
IQEVVQYIKRLEEAQSKRQEKLVEKHKEIRQQILDEKPKVP

SEQ ID NO: 63295 - protein, 196 aa, Homo sapiens
  Payload ID: 12633
  Gene Symbol: PLCB1
  Gene Name: phospholipase C, beta 1 (phosphoinositide-specific)
  ENSP ID: ENSP00000391162
IISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEGGFLHDEIMRLTRNTLEKLMALPLTHVVPIQSKMLS

SEQ ID NO: 63296 - protein, 914 aa, Homo sapiens
  Payload ID: 12633
  Gene Symbol: PLCB1
  Gene Name: phospholipase C, beta 1 (phosphoinositide-specific)
  ENSP ID: ENSP00000431704
  MOD_RES (1)..(1): Any amino acid
XILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKGEGSSSFLSETCHEDPSVSPNFTPPNPQALKW

SEQ ID NO: 63297 - protein, 1136 aa, Homo sapiens [sequence omitted]

SEQ ID NO: 63298 - protein, 1093 aa, Homo sapiens [sequence omitted]

SEQ ID NO: 63299 - protein, 960 aa, Homo sapiens
  Payload ID: 12633
  Gene Symbol: PLCB1
  Gene Name: phospholipase C, beta 1 (phosphoinositide-specific)
  ENSP ID: ENSP00000486301
MITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEIC

SEQ ID NO: 63300 - protein, 26 aa, Homo sapiens
  Payload ID: 12633
  Gene Symbol: PLCB1
  Gene Name: phospholipase C, beta 1 (phosphoinositide-specific)
  ENSP ID: ENSP00000486428
  MOD_RES (1)..(1): Any amino acid
XADRKRVETALEACSLPSSRALRIWW

SEQ ID NO: 63301 - protein, 248 aa, Homo sapiens
  Payload ID: 12633
  Gene Symbol: PLCB1
  Gene Name: phospholipase C, beta 1 (phosphoinositide-specific)
  ENSP ID: ENSP00000486531
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRVEKANEAAKSEQSCGKAPPKHFHLHFIKQNKMLEPACYCFFVRCFGIGKI

SEQ ID NO: 63302 - protein, 136 aa, Homo sapiens
  Payload ID: 12633
  Gene Symbol: PLCB1
  Gene Name: phospholipase C, beta 1 (phosphoinositide-specific)
  ENSP ID: ENSP00000486655
MITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSK

SEQ ID NO: 63303 - protein, 961 aa, Homo sapiens
  Payload ID: 12633
  Gene Symbol: PLCB1
  Gene Name: phospholipase C, beta 1 (phosphoinositide-specific)
  ENSP ID: ENSP00000487075
MITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICE

SEQ ID NO: 63304 - protein, 231 aa, Homo sapiens
  Payload ID: 12633
  Gene Symbol: PLCB1
  Gene Name: phospholipase C, beta 1 (phosphoinositide-specific)
  ENSP ID: ENSP00000487544
  MOD_RES (1)..(1): Any amino acid
XQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKVAP

SEQ ID NO: 63305 - protein, 1185 aa, Homo sapiens
  Payload ID: 12634
  Gene Symbol: PLCB2
  Gene Name: phospholipase C, beta 2
  Uniprot ID: Q00722
  ENSP ID: ENSP00000260402
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAGEGTVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQFQKEALAEYEARMKGLEAEVKESVRACLRTCFPSEAKDKPERACECPPELCEQDPLIAKADAQESRL

SEQ ID NO: 63306 - protein, 1170 aa, Homo sapiens
  Payload ID: 12634
  Gene Symbol: PLCB2
  Gene Name: phospholipase C, beta 2
  Uniprot ID: Q00722
  ENSP ID: ENSP00000411991
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAGEGTVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQFQKEALAEYEARMKGLEAEVKESVRACLRTCFPSEAKDKPERACECPPELCEQDPLIAKADAQESRL

SEQ ID NO: 63307 - protein, 199 aa, Homo sapiens
  Payload ID: 12634
  Gene Symbol: PLCB2
  Gene Name: phospholipase C, beta 2
  ENSP ID: ENSP00000444652
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKPGGAR

SEQ ID NO: 63308 - protein, 87 aa, Homo sapiens
  Payload ID: 12634
  Gene Symbol: PLCB2
  Gene Name: phospholipase C, beta 2
  ENSP ID: ENSP00000452916
  MOD_RES (1)..(1): Any amino acid
XDTKEMKKKLETKRLERIQGMTKVTTDKMAQERLKREINNSHIQEVVQVIKQMTENLERHQEKLEEKQAACLEQIREMEKQPDPAHP

SEQ ID NO: 63309 - protein, 1181 aa, Homo sapiens
  Payload ID: 12634
  Gene Symbol: PLCB2
  Gene Name: phospholipase C, beta 2
  Uniprot ID: Q00722
  ENSP ID: ENSP00000453975
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQFQKEALAEYEARMKGLEAEVKESVRACLRTCFPSEAKDKPERACECPPELCEQDPLIAKADAQESRL

SEQ ID NO: 63310 - protein, 74 aa, Homo sapiens
  Payload ID: 12634
  Gene Symbol: PLCB2
  Gene Name: phospholipase C, beta 2
  ENSP ID: ENSP00000454025
IREMEKQFQKEALAEYEARMKGLEAEVKESVRACLRTCFPSEAKDKPERACECPPELCEQDPLIAKADAQESRL

SEQ ID NO: 63311 - protein, 1234 aa, Homo sapiens
  Payload ID: 12635
  Gene Symbol: PLCB3
  Gene Name: phospholipase C, beta 3 (phosphatidylinositol-specific)
  Uniprot ID: Q01970
  ENSP ID: ENSP00000279230
MAGAQPGVHALQLEPPTVVETLRRGSKFIKWDEETSSRNLVTLRVDPNGFFLYWTGPNMEVDTLDISSIRDTRTGRYARLPKDPKIREVLGFGGPDARLEEKLMTVVSGPDPVNTVFLNFMAVQDDTAKVWSEELFKLAMNILAQNASRNTFLRKAYTKLKLQVNQDGRIPVKNILKMFSADKKRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 63312 - protein, 1167 aa, Homo sapiens
  Payload ID: 12635
  Gene Symbol: PLCB3
  Gene Name: phospholipase C, beta 3 (phosphatidylinositol-specific)
  Uniprot ID: Q01970
  ENSP ID: ENSP00000324660
MAGAQPGVHALQLEPPTVVETLRRGSKFIKWDEEKLMTVVSGPDPVNTVFLNFMAVQDDTAKVWSEELFKLAMNILAQNASRNTFLRKAYTKLKLQVNQDGRIPVKNILKMFSADKKRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 63313 - protein, 1234 aa, Homo sapiens; identical to SEQ ID NO: 63311
  Payload ID: 12635
  Gene Symbol: PLCB3
  Gene Name: phospholipase C, beta 3 (phosphatidylinositol-specific)
  Uniprot ID: Q01970
  ENSP ID: ENSP00000443631

SEQ ID NO: 63314 - protein, 1175 aa, Homo sapiens
  Payload ID: 12636
  Gene Symbol: PLCB4
  Gene Name: phospholipase C, beta 4
  Uniprot ID: Q15147
  ENSP ID: ENSP00000278655
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 63315 - protein, 1187 aa, Homo sapiens
  Payload ID: 12636
  Gene Symbol: PLCB4
  Gene Name: phospholipase C, beta 4
  Uniprot ID: Q15147
  ENSP ID: ENSP00000367734
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKASDDLEHENNKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 63316 - protein, 1175 aa, Homo sapiens; identical to SEQ ID NO: 63314
  Payload ID: 12636
  Gene Symbol: PLCB4
  Gene Name: phospholipase C, beta 4
  Uniprot ID: Q15147
  ENSP ID: ENSP00000367754

SEQ ID NO: 63317 - protein, 1194 aa, Homo sapiens
  Payload ID: 12636
  Gene Symbol: PLCB4
  Gene Name: phospholipase C, beta 4
  Uniprot ID: Q15147
  ENSP ID: ENSP00000367762
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQLLKSCHAVSQTQGEGDAADGEIGSRDGPQTSNSSMKLQNAN

SEQ ID NO: 63318 - protein, 113 aa, Homo sapiens
  Payload ID: 12636
  Gene Symbol: PLCB4
  Gene Name: phospholipase C, beta 4
  ENSP ID: ENSP00000385805
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNISFTY

SEQ ID NO: 63319 - protein, 1187 aa, Homo sapiens; identical to SEQ ID NO: 63315
  Payload ID: 12636
  Gene Symbol: PLCB4
  Gene Name: phospholipase C, beta 4
  Uniprot ID: Q15147
  ENSP ID: ENSP00000390616

SEQ ID NO: 63320 - protein, 81 aa, Homo sapiens
  Payload ID: 12636
  Gene Symbol: PLCB4
  Gene Name: phospholipase C, beta 4
  ENSP ID: ENSP00000391614
MAKPYEFNWQKEVPSFLQEGAVFDRYEEESFVFEPNCLFKVDEFGFFLTWRSEGKEGQVLECSLINSIRSGAIPKDPKILA

SEQ ID NO: 63321 - protein, 59 aa, Homo sapiens
  Payload ID: 12636
  Gene Symbol: PLCB4
  Gene Name: phospholipase C, beta 4
  ENSP ID: ENSP00000395753
MAKPYEFNWQKEVPSFLQEGAVFDRYEEESFVFEPNCLFKVDEFGFFLTWRSEGKEGQV

SEQ ID NO: 63322 - protein, 110 aa, Homo sapiens
  Payload ID: 12636
  Gene Symbol: PLCB4
  Gene Name: phospholipase C, beta 4
  ENSP ID: ENSP00000412982
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNIS

SEQ ID NO: 63323 - protein, 756 aa, Homo sapiens
  Payload ID: 12637
  Gene Symbol: PLCD1
  Gene Name: phospholipase C, delta 1
  Uniprot ID: P51178
  ENSP ID: ENSP00000335600
MDSGRDFLTLHGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGSGETLSVDQLVTFLQHQQREEAAGPALALSLIERYEPSETAKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQGRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 63324 - protein, 777 aa, Homo sapiens
  Payload ID: 12637
  Gene Symbol: PLCD1
  Gene Name: phospholipase C, delta 1
  Uniprot ID: P51178
  ENSP ID: ENSP00000430344
MQCLGIRSRSRSRELYLQERSLKVAALNGRRLGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGSGETLSVDQLVTFLQHQQREEAAGPALALSLIERYEPSETAKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQGRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 63325 - protein, 127 aa, Homo sapiens
  Payload ID: 12638
  Gene Symbol: PLCD3
  Gene Name: phospholipase C, delta 3
  ENSP ID: ENSP00000440378
MLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYL

SEQ ID NO: 63326 - protein, 111 aa, Homo sapiens
  Payload ID: 12638
  Gene Symbol: PLCD3
  Gene Name: phospholipase C, delta 3
  ENSP ID: ENSP00000443079
  MOD_RES (1)..(1): Any amino acid
XVNGQCGYVLKPACLRQPDSTFDPEYPGPPRTTLSIQVLTAQQLPKLNAEKPHSIVDPLVRIEIHGVPADCARQETDYVLNNGYRHIHLLSKDGASLSPATLFIQIRIQRS

SEQ ID NO: 63327 - protein, 195 aa, Homo sapiens
  Payload ID: 12638
  Gene Symbol: PLCD3
  Gene Name: phospholipase C, delta 3
  ENSP ID: ENSP00000467800
MSLPDPGHRPQKRCHLDVPHFAHALWCLHINSLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDM

SEQ ID NO: 63328 - protein, 789 aa, Homo sapiens
  Payload ID: 12638
  Gene Symbol: PLCD3
  Gene Name: phospholipase C, delta 3
  Uniprot ID: Q8N3E9
  ENSP ID: ENSP00000479636
MLCGRWRRCRRPPEEPPVAAQVAAQVAAPVALPSPPTPSDGGTKRPGLRALKKMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 63329 - protein, 762 aa, Homo sapiens
  Payload ID: 12639
  Gene Symbol: PLCD4
  Gene Name: phospholipase C, delta 4
  Uniprot ID: Q9BRC7
  ENSP ID: ENSP00000388631
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDQWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKKSKPILCPALSSLVIYLKSVSFRSFTHSKEHYHFYEISSFSETKAKRLIKEAGNEFVQHNTWQLSRVYPSGLRTDSSNYNPQELWNAGCQMVAMNMQTAGLEMDICDGHFRQNGGCGYVLKPDFLRDIQSSFHPEKPISPFKAQTLLIQVISGQQLPKVDKTKEGSIVDPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 63330 - protein, 98 aa, Homo sapiens
  Payload ID: 12639
  Gene Symbol: PLCD4
  Gene Name: phospholipase C, delta 4
  ENSP ID: ENSP00000391850
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGR

SEQ ID NO: 63331 - protein, 794 aa, Homo sapiens
  Payload ID: 12639
  Gene Symbol: PLCD4
  Gene Name: phospholipase C, delta 4
  ENSP ID: ENSP00000396185
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDQWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKVVTCPLFCPSICCQIVAQAPISKPESLLLSRQKSKPILCPALSSLVIYLKSVSFRSFTHSKEHYHFYEISSFSETKAKRLIKEAGNEFVQHNTWQLSRVYPSGLRTDSSNYNPQELWNAGCQMVAMNMQTAGLEMDICDGHFRQNGGCGYVLKPDFLRDIQSSFHPEKPISPFKAQTLLIQVISGQQLPKVDKTKEGSIVDPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 63332 - protein, 762 aa, Homo sapiens; identical to SEQ ID NO: 63329
  Payload ID: 12639
  Gene Symbol: PLCD4
  Gene Name: phospholipase C, delta 4
  Uniprot ID: Q9BRC7
  ENSP ID: ENSP00000396942

SEQ ID NO: 63333 - protein, 123 aa, Homo sapiens
  Payload ID: 12639
  Gene Symbol: PLCD4
  Gene Name: phospholipase C, delta 4
  ENSP ID: ENSP00000403935
  MOD_RES (1)..(1): Any amino acid
XQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKAMSLCSTILGS

SEQ ID NO: 63334 - protein, 111 aa, Homo sapiens
  Payload ID: 12639
  Gene Symbol: PLCD4
  Gene Name: phospholipase C, delta 4
  ENSP ID: ENSP00000404481
  MOD_RES (1)..(1): Any amino acid
XPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 63335 - protein, 69 aa, Homo sapiens
  Payload ID: 12639
  Gene Symbol: PLCD4
  Gene Name: phospholipase C, delta 4
  ENSP ID: ENSP00000406040
MASLLQDQLTTDQDLLLMQEGMPMRKSQSLMWRQYVMAMIPSCCVAWQRSSPWSRASPLSSMAAAPTWT

SEQ ID NO: 63336 - protein, 69 aa, Homo sapiens; identical to SEQ ID NO: 63335
  Payload ID: 12639
  Gene Symbol: PLCD4
  Gene Name: phospholipase C, delta 4
  ENSP ID: ENSP00000415725

SEQ ID NO: 63337 - protein, 2302 aa, Homo sapiens
  Payload ID: 12640
  Gene Symbol: PLCE1
  Gene Name: phospholipase C, epsilon 1
  Uniprot ID: Q9P212
  ENSP ID: ENSP00000260766
MTSEEMTASVLIPVTQRKVVSAQSAADESSEKVSDINISKAHTVRRSGETSHTISQLNKLKEEPSGSNLPKILSIAREKIVSDENSNEKCWEKIMPDSAKNLNINCNNILRNHQHGLPQRQFYEMYNSVAEEDLCLETGIPSPLERKVFPGIQLELDRPSMGISPLGNQSVIIETGRAHPDSRRAVFHFHYEVDRRMSDTFCTLSENLILDDCGNCVPLPGGEEKQKKNYVAYTCKLMELAKNCDNKNEQLQCDHCDTLNDKYFCFEGSCEKVDMVYSGDSFCRKDFTDSQAAKTFLSHFEDFPDNCDDVEEDAFKSKKERSTLLVRRFCKNDREVKKSVYTGTRAIVRTLPSGHIGLTAWSYIDQKRNGPLLPCGRVMEPPSTVEIRQDGSQRLSEAQWYPIYNAVRREETENTVGSLLHFLTKLPASETAHGRISVGPCLKQCVRDTVCEYRATLQRTSISQYITGSLLEATTSLGARSGLLSTFGGSTGRMMLKERQPGPSVANSNALPSSSAGISKELIDLQPLIQFPEEVASILMEQEQTIYRRVLPVDYLCFLTRDLGTPECQSSLPCLKASISASILTTQNGEHNALEDLVMRFNEVSSWVTWLILTAGSMEEKREVFSYLVHVAKCCWNMGNYNAVMEFLAGLRSRKVLKMWQFMDQSDIETMRSLKDAMAQHESSCEYRKVVTRALHIPGCKVVPFCGVFLKELCEVLDGASGLMKLCPRYNSQEETLEFVADYSGQDNFLQRVGQNGLKNSEKESTVNSIFQVIRSCNRSLETDEEDSPSEGNSSRKSSLKDKSRWQFIIGDLLDSDNDIFEQSKEYDSHGSEDSQKAFDHGTELIPWYVLSIQADVHQFLLQGATVIHYDQDTHLSARCFLQLQPDNSTLTWVKPTTASPASSKAKLGVLNNTAEPGKFPLLGNAGLSSLTEGVLDLFAVKAVYMGHPGIDIHTVCVQNKLGSMFLSETGVTLLYGLQTTDNRLLHFVAPKHTAKMLFSGLLELTRAVRKMRKFPDQRQQWLRKQYVSLYQEDGRYEGPTLAHAVELFGGRRWSARNPSPGTSAKNAEKPNMQRNNTLGISTTKKKKKILMRGESGEVTDDEMATRKAKMHKECRSRSGSDPQDINEQEESEVNAIANPPNPLPSRRAHSLTTAGSPNLAAGTSSPIRPVSSPVLSSSNKSPSSAWSSSSWHGRIKGGMKGFQSFMVSDSNMSFVEFVELFKSFSVRSRKDLKDLFDVYAVPCNRSGSESAPLYTNLTIDENTSDLQPDLDLLTRNVSDLGLFIKSKQQLSDNQRQISDAIAAASIVTNGTGIESTSLGIFGVGILQLNDFLVNCQGEHCTYDEILSIIQKFEPSISMCHQGLMSFEGFARFLMDKENFASKNDESQENIKELQLPLSYYYIESSHNTYLTGHQLKGESSVELYSQVLLQGCRSVELDCWDGDDGMPIIYHGHTLTTKIPFKEVVEAIDRSAFINSDLPIIISIENHCSLPQQRKMAEIFKTVFGEKLVTKFLFETDFSDDPMLPSPDQLRKKVLLKNKKLKAHQTPVDILKQKAHQLASMQVQAYNGGNANPRPANNEEEEDEEDEYDYDYESLSDDNILEDRPENKSCNDKLQFEYNEEIPKRIKKADNSACNKGKVYDMELGEEFYLDQNKKESRQIAPELSDLVIYCQAVKFPGLSTLNASGSSRGKERKSRKSIFGNNPGRMSPGETASFNKTSGKSSCEGIRQTWEESSSPLNPTTSLSAIIRTPKCYHISSLNENAAKRLCRRYSQKLTQHTACQLLRTYPAATRIDSSNPNPLMFWLHGIQLVALNYQTDDLPLHLNAAMFEANGGCGYVLKPPVLWDKNCPMYQKFSPLERDLDSMDPAVYSLTIVSGQNVCPSNSMGSPCIEVDVLGMPLDSCHFRTKPIHRNTLNPMWNEQFLFHVHFEDLVFLRFAVVENNSSAVTAQRIIPLKALKRGYRHLQLRNLHNEVLEISSLFINSRRMEENSSGNTMSASSMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 63338 - protein, 1994 aa, Homo sapiens
  Payload ID: 12640
  Gene Symbol: PLCE1
  Gene Name: phospholipase C, epsilon 1
  Uniprot ID: Q9P212
  ENSP ID: ENSP00000360426
MVSEGSAAGRDFAGMEEVRQLHVRFCKGIKIWHQAWFLCSLLGREPQEREAGCQLWLCTLSAVLKVGWLFPLSEVPNFTLLKDGCGCWRLKEDQIYNAVRREETENTVGSLLHFLTKLPASETAHGRISVGPCLKQCVRDTVCEYRATLQRTSISQYITGSLLEATTSLGARSGLLSTFGGSTGRMMLKERQPGPSVANSNALPSSSAGISKELIDLQPLIQFPEEVASILMEQEQTIYRRVLPVDYLCFLTRDLGTPECQSSLPCLKASISASILTTQNGEHNALEDLVMRFNEVSSWVTWLILTAGSMEEKREVFSYLVHVAKCCWNMGNYNAVMEFLAGLRSRKVLKMWQFMDQSDIETMRSLKDAMAQHESSCEYRKVVTRALHIPGCKVVPFCGVFLKELCEVLDGASGLMKLCPRYNSQEETLEFVADYSGQDNFLQRVGQNGLKNSEKESTVNSIFQVIRSCNRSLETDEEDSPSEGNSSRKSSLKDKSRWQFIIGDLLDSDNDIFEQSKEYDSHGSEDSQKAFDHGTELIPWYVLSIQADVHQFLLQGATVIHYDQDTHLSARCFLQLQPDNSTLTWVKPTTASPASSKAKLGVLNNTAEPGKFPLLGNAGLSSLTEGVLDLFAVKAVYMGHPGIDIHTVCVQNKLGSMFLSETGVTLLYGLQTTDNRLLHFVAPKHTAKMLFSGLLELTRAVRKMRKFPDQRQQWLRKQYVSLYQEDGRYEGPTLAHAVELFGGRRWSARNPSPGTSAKNAEKPNMQRNNTLGISTTKKKKKILMRGESGEVTDDEMATRKAKMHKECRSRSGSDPQDINEQEESEVNAIANPPNPLPSRRAHSLTTAGSPNLAAGTSSPIRPVSSPVLSSSNKSPSSAWSSSSWHGRIKGGMKGFQSFMVSDSNMSFVEFVELFKSFSVRSRKDLKDLFDVYAVPCNRSGSESAPLYTNLTIDENTSDLQPDLDLLTRNVSDLGLFIKSKQQLSDNQRQISDAIAAASIVTNGTGIESTSLGIFGVGILQLNDFLVNCQGEHCTYDEILSIIQKFEPSISMCHQGLMSFEGFARFLMDKENFASKNDESQENIKELQLPLSYYYIESSHNTYLTGHQLKGESSVELYSQVLLQGCRSVELDCWDGDDGMPIIYHGHTLTTKIPFKEVVEAIDRSAFINSDLPIIISIENHCSLPQQRKMAEIFKTVFGEKLVTKFLFETDFSDDPMLPSPDQLRKKVLLKNKKLKAHQTPVDILKQKAHQLASMQVQAYNGGNANPRPANNEEEEDEEDEYDYDYESLSDDNILEDRPENKSCNDKLQFEYNEEIPKRIKKADNSACNKGKVYDMELGEEFYLDQNKKESRQIAPELSDLVIYCQAVKFPGLSTLNASGSSRGKERKSRKSIFGNNPGRMSPGETASFNKTSGKSSCEGIRQTWEESSSPLNPTTSLSAIIRTPKCYHISSLNENAAKRLCRRYSQKLTQHTACQLLRTYPAATRIDSSNPNPLMFWLHGIQLVALNYQTDDLPLHLNAAMFEANGGCGYVLKPPVLWDKNCPMYQKFSPLERDLDSMDPAVYSLTIVSGQNVCPSNSMGSPCIEVDVLGMPLDSCHFRTKPIHRNTLNPMWNEQFLFHVHFEDLVFLRFAVVENNSSAVTAQRIIPLKALKRGYRHLQLRNLHNEVLEISSLFINSRRMEENSSGNTMSASSMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 63339 - protein, 2302 aa, Homo sapiens; identical to SEQ ID NO: 63337
  Payload ID: 12640
  Gene Symbol: PLCE1
  Gene Name: phospholipase C, epsilon 1
  Uniprot ID: Q9P212
  ENSP ID: ENSP00000360431

SEQ ID NO: 63340 - protein, 1994 aa, Homo sapiens; identical to SEQ ID NO: 63338
  Payload ID: 12640
  Gene Symbol: PLCE1
  Gene Name: phospholipase C, epsilon 1
  Uniprot ID: Q9P212
  ENSP ID: ENSP00000360438

SEQ ID NO: 63341 - protein, 1655 aa, Homo sapiens
  Payload ID: 12641
  Gene Symbol: PLCH1
  Gene Name: phospholipase C, eta 1
  Uniprot ID: Q4KWH8
  ENSP ID: ENSP00000335469
MSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLAEDKDGRRKGKASIKDPHFLNFNKKLSSSSSALLHKDTSQGDTIVSTAHMSVTGEQLGMSSPRGGRTTSNATSNCQENPCPSKSLSPKQHLAPDPVVNPTQDLHGVKIKEKGNPEDFVEGKSILSGSVLSHSNLEIKNLEGNRGKGRAATSFSLSDVSMLCSDIPDLHSTAILQESVISHLIDNVTLTNENEPGSSISALIGQFDETNNQALTVVSHLHNTSVMSGHCPLPSLGLKMPIKHGFCKGKSKSSFLCSSPELIALSSSETTKHATNTVYETTCTPISKTKPDDDLSSKAKTAALESNLPGSPNTSRGWLPKSPTKGEDWETLKSCSPASSPDLTLEDVIADPTLCFNSGESSLVEIDGESENLSLTTCEYRREGTSQLASPLKLKYNQGVVEHFQRGLRNGYCKETLRPSVPEIFNNIQDVKTQSISYLAYQGAGFVHNHFSDSDAKMFQTCVPQQSSAQDMHVPVPKQLAHLPLPALKLPSPCKSKSLGDLTSEDIACNFESKYQCISKSFVTTGIRDKKGVTVKTKSLEPIDALTEQLRKLVSFDQEDNCQVLYSKQDANQLPRALVRKLSSRSQSRVRNIASRAKEKQEANKQKVPNPSNGAGVVLRNKPSAPTPAVNRHSTGSYIAGYLKNTKGGGLEGRGIPEGACTALHYGHVDQFCSDNSVLQTEPSSDDKPEIYFLLRL

SEQ ID NO: 63342 - protein, 1693 aa, Homo sapiens
  Payload ID: 12641
  Gene Symbol: PLCH1
  Gene Name: phospholipase C, eta 1
  Uniprot ID: Q4KWH8
  ENSP ID: ENSP00000345988
MADLEVYKNLSPEKVERCMSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKWSPLILNPSYTILHFLGATKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLAEDKDGRRKGKASIKDPHFLNFNKKLSSSSSALLHKDTSQGDTIVSTAHMSVTGEQLGMSSPRGGRTTSNATSNCQENPCPSKSLSPKQHLAPDPVVNPTQDLHGVKIKEKGNPEDFVEGKSILSGSVLSHSNLEIKNLEGNRGKGRAATSFSLSDVSMLCSDIPDLHSTAILQESVISHLIDNVTLTNENEPGSSISALIGQFDETNNQALTVVSHLHNTSVMSGHCPLPSLGLKMPIKHGFCKGKSKSSFLCSSPELIALSSSETTKHATNTVYETTCTPISKTKPDDDLSSKAKTAALESNLPGSPNTSRGWLPKSPTKGEDWETLKSCSPASSPDLTLEDVIADPTLCFNSGESSLVEIDGESENLSLTTCEYRREGTSQLASPLKLKYNQGVVEHFQRGLRNGYCKETLRPSVPEIFNNIQDVKTQSISYLAYQGAGFVHNHFSDSDAKMFQTCVPQQSSAQDMHVPVPKQLAHLPLPALKLPSPCKSKSLGDLTSEDIACNFESKYQCISKSFVTTGIRDKKGVTVKTKSLEPIDALTEQLRKLVSFDQEDNCQVLYSKQDANQLPRALVRKLSSRSQSRVRNIASRAKEKQEANKQKVPNPSNGAGVVLRNKPSAPTPAVNRHSTGSYIAGYLKNTKGGGLEGRGIPEGACTALHYGHVDQFCSDNSVLQTEPSSDDKPEIYFLLRL

SEQ ID NO: 63343 - protein, 1002 aa, Homo sapiens
  Payload ID: 12641
  Gene Symbol: PLCH1
  Gene Name: phospholipase C, eta 1
  Uniprot ID: Q4KWH8
  ENSP ID: ENSP00000402759
MADLEVYKNLSPEKVERCMSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKWSPLILNPSYTILHFLGATKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLVQI

SEQ ID NO: 63344 - protein, 1655 aa, Homo sapiens; identical to SEQ ID NO: 63341
  Payload ID: 12641
  Gene Symbol: PLCH1
  Gene Name: phospholipase C, eta 1
  Uniprot ID: Q4KWH8
  ENSP ID: ENSP00000417502

SEQ ID NO: 63345 - protein, 1014 aa, Homo sapiens
  Payload ID: 12641
  Gene Symbol: PLCH1
  Gene Name: phospholipase C, eta 1
  Uniprot ID: Q4KWH8
  ENSP ID: ENSP00000419100
MADLEVYKNLSPEKVERCMSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLDSSFCRPTEQAKAEMCKVPFPRQLECVMKMEISET

SEQ ID NO: 63346 - protein, 1239 aa, Homo sapiens
  Payload ID: 12642
  Gene Symbol: PLCH2
  Gene Name: phospholipase C, eta 2
  ENSP ID: ENSP00000278878
  MOD_RES (1)..(1): Any amino acid
XARTWVTGLRYLMAGISDEDSLARRQRTRDQWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRDTRPLSTQRPLPPLCSLETIAEEPAPGPGPPPPAAVPTSSSQGRPPYPTGPGANVASPLEDTEEPRDSRPRPCNGEGAGGAYERAPGSQTDGRSQPRTLGHLPVIRRVKSEGQVPTEPLGGWRPLAAPFPAPAVYSDATGSDPLWQRLEPCGHRDSVSSSSSMSSSDTVIDLSLPSLGLGRSRENLAGAHMGRLPPRPHSASAARPDLPPVTKSKSNPNLRATGQRPPIPDELQPRSLAPRMAGLPFRPPWGCLSLVGVQDCPVAAKSKSLGDLTADDFAPSFEGGSRRLSHSLGLPGGTRRVSGPGVRRDTLTEQLRWLTVFQQAGDITSPTSLGPAGEGVAGGPGFVRRSSSRSHSRVRAIASRARQAQERQQRLQGLGRQGPPEEERGTPEGACSVGHEGSVDAPAPSKGALGPASAAAENLVLLRL

SEQ ID NO: 63347 - protein, 1416 aa, Homo sapiens
  Payload ID: 12642
  Gene Symbol: PLCH2
  Gene Name: phospholipase C, eta 2
  Uniprot ID: O75038
  ENSP ID: ENSP00000367747
MSGPWPSPDSRTKGTVAWLAEVLLWVGGSVVLSSEWQLGPLVERCMGAMQEGMQMVKLRGGSKGLVRFYYLDEHRSCIRWRPSRKNEKAKISIDSIQEVSEGRQSEVFQRYPDGSFDPNCCFSIYHGSHRESLDLVSTSSEVARTWVTGLRYLMAGISDEDSLARRQRTRDQWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMVALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRDTRPLSTQRPLPPLCSLETIAEEPAPGPGPPPPAAVPTSSSQGRPPYPTGPGANVASPLEDTEEPRDSRPRPCNGEGAGGAYERAPGSQTDGRSQPRTLGHLPVIRRVKSEGQVPTEPLGGWRPLAAPFPAPAVYSDATGSDPLWQRLEPCGHRDSVSSSSSMSSSDTVIDLSLPSLGLGRSRENLAGAHMGRLPPRPHSASAARPDLPPVTKSKSNPNLRATGQRPPIPDELQPRSLAPRMAGLPFRPPWGCLSLVGVQDCPVAAKSKSLGDLTADDFAPSFEGGSRRLSHSLGLPGGTRRVSGPGVRRDTLTEQLRWLTVFQQAGDITSPTSLGPAGEGVAGGPGFVRRSSSRSHSRVRAIASRARQAQERQQRLQGLGRQGPPEEERGTPEGACSVGHEGSVDAPAPSKGALGPASAAAENLVLLRL

SEQ ID NO: 63348 - protein, 1416 aa, Homo sapiens; identical to SEQ ID NO: 63347
  Payload ID: 12642
  Gene Symbol: PLCH2
  Gene Name: phospholipase C, eta 2
  Uniprot ID: O75038
  ENSP ID: ENSP00000389803

SEQ ID NO: 63349 - protein, 1129 aa, Homo sapiens
  Payload ID: 12642
  Gene Symbol: PLCH2
  Gene Name: phospholipase C, eta 2
  Uniprot ID: O75038
  ENSP ID: ENSP00000397289
MEEPGPPGGLSQDQVERCMGAMQEGMQMVKLRGGSKGLVRFYYLDEHRSCIRWRPSRKNEKAKISIDSIQEVSEGRQSEVFQRYPDGSFDPNCCFSIYHGSHRESLDLVSTSSEVARTWVTGLRYLMAGISDEDSLARRQRTRDQWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMVALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRGKAPAAVAEKSPVRVRPPRVLDGPGPAGMAATCMKCVVGSCAGVNTGGLQRERPPSPGPASRQAAIRQQPRARADSLGAPCCGLDPHAIPGRSREAPKGPGAWRQGPGGSGSMSSDSSSPDSPGIPERSPRWPEGACRQPGALQGEMSALFAQKLEEIRSKSPMFSAVRN

SEQ ID NO: 63350 - protein, 111 aa, Homo sapiens
  Payload ID: 12642
  Gene Symbol: PLCH2
  Gene Name: phospholipase C, eta 2
  ENSP ID: ENSP00000476436
MMAPPTAGPLPGPALPPEDPGPDPESRWLFLSANILPVVERCMGAMQEGMQMVKLRGGSKGLVRFYYLDEHRSCIRWRPSRKNEKAKISIDSIQEVSEGRQSEVFQRYPDG

SEQ ID NO: 63351 - protein, 1416 aa, Homo sapiens; identical to SEQ ID NO: 63347
  Payload ID: 12642
  Gene Symbol: PLCH2
  Gene Name: phospholipase C, eta 2
  Uniprot ID: O75038
  ENSP ID: ENSP00000481938

SEQ ID NO: 63352 - protein, 1416 aa, Homo sapiens; identical to SEQ ID NO: 63347
  Payload ID: 12642
  Gene Symbol: PLCH2
  Gene Name: phospholipase C, eta 2
  Uniprot ID: O75038
  ENSP ID: ENSP00000486186

SEQ ID NO: 63353 - protein, 1129 aa, Homo sapiens; identical to SEQ ID NO: 63349
  Payload ID: 12642
  Gene Symbol: PLCH2
  Gene Name: phospholipase C, eta 2
  Uniprot ID: O75038
  ENSP ID: ENSP00000487140

SEQ ID NO: 63354 - protein, 1291 aa, Homo sapiens
  Payload ID: 12643
  Gene Symbol: PLCG1
  Gene Name: phospholipase C, gamma 1
  Uniprot ID: P19174
  ENSP ID: ENSP00000244007
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARLTEGKIMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFMTGRHCGYVLQPSTMRDEAFDPFDKSSLRGLEPCAISIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKQENGDLSPFSGTSLRERGSDASGQLFHGRAREGSFESRYQQPFEDFRISQEHLADHFDSRERRAPRRTRVNGDNRL

SEQ ID NO: 63355 - protein, 1290 aa, Homo sapiens
  Payload ID: 12643
  Gene Symbol: PLCG1
  Gene Name: phospholipase C, gamma 1
  Uniprot ID: P19174
  ENSP ID: ENSP00000362368
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARLTEGKIMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFMTGRHCGYVLQPSTMRDEAFDPFDKSSLRGLEPCAISIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKENGDLSPFSGTSLRERGSDASGQLFHGRAREGSFESRYQQPFEDFRISQEHLADHFDSRERRAPRRTRVNGDNRL

SEQ ID NO: 63356 - protein, 50 aa, Homo sapiens
  Payload ID: 12643
  Gene Symbol: PLCG1
  Gene Name: phospholipase C, gamma 1
  ENSP ID: ENSP00000468958
DVAADSQEELQDWVKKIREVAQTADARRLAQNVLATGTCHPSRKPRLRNT

SEQ ID NO: 63357 - protein, 219 aa, Homo sapiens
  Payload ID: 12643
  Gene Symbol: PLCG1
  Gene Name: phospholipase C, gamma 1
  ENSP ID: ENSP00000476432
LQYNRLQLSRIYPKGQRLDSSNYDPLPMWICGSQLVALNFQTPDKPMQMNQALFMTGRHCGYVLQPSTMRDEAFDPFDKSSLRGLEPCAISIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKKLLC

SEQ ID NO: 63358 - protein, 108 aa, Homo sapiens
  Payload ID: 12643
  Gene Symbol: PLCG1
  Gene Name: phospholipase C, gamma 1
  ENSP ID: ENSP00000476454
LKTGYRAVPLKNNYSEDLELASLLIKIDIFPAKENGDLSPFSGTSLRERGSDASGQLFHGRAREGSFESRYQQPFEDFRISQEHLADHFDSRERRAPRRTRVNGDNRL

SEQ ID NO: 63359 - protein, 133 aa, Homo sapiens
  Payload ID: 12643
  Gene Symbol: PLCG1
  Gene Name: phospholipase C, gamma 1
  ENSP ID: ENSP00000476757
  MOD_RES (1)..(1): Any amino acid
XFVVYEEDMFSDQNFLAQATFPVKGLKTGYRAVPLKNNYSEDLELASLLIKIDIFPAKENGDLSPFSGTSLRERGSDASGQLFHGRAREGSFESRYQQPFEDFRISQEHLADHFDSRERRAPRRTRVNGDNRL

SEQ ID NO: 63360 - protein, 132 aa, Homo sapiens
  Payload ID: 12643
  Gene Symbol: PLCG1
  Gene Name: phospholipase C, gamma 1
  ENSP ID: ENSP00000485760
  MOD_RES (1)..(1): Any amino acid
XQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARDLAAEISGPFQHS

SEQ ID NO: 63361 - protein, 1252 aa, Homo sapiens
  Payload ID: 12644
  Gene Symbol: PLCG2
  Gene Name: phospholipase C, gamma 2 (phosphatidylinositol-specific)
  ENSP ID: ENSP00000352336
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRNSISLRELKTILPLINFKVSSAKFLKDKFVEIGAHKDELSFEQFHLFYKKLMFEQQKSILDEFKKDSSVFILGNTDRPDASAVYLHDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSSFPVILSIEEHCSVEQQRHMAKAFKEVFGDLLLTKPTEASADQLPSPSQLREKIIIKHKKLGPRGDVDVNMEDKKDEHKQQGELYMWDSIDQKWTRHYCAIADAKLSFSDDIEQTMEEEVPQDIPPTELHFGEKWFHKKVEKRTSAEKLLQEYCMETGGKDGTFLVRESETFPNDYTLSFWRSGRVQHCRIRSTMEGGTLKYYLTDNLTFSSIYALIQHYRETHLRCAEFELRLTDPVPNPNPHESKPWYYDSLSRGEAEDMLMRIPRDGAFLIRKREGSDSYAITFRARGKVKHCRINRDGRHFVLGTSAYFESLVELVSYYEKHSLYRKMRLRYPVTPELLERYNMERDINSLYDVSRMYVDPSEINPSMPQRTVKALYDYKAKRSDELSFCRGALIHNVSKEPGGWWKGDYGTRIQQYFPSNYVEDISTADFEELEKQIIEDNPLGSLCRGILDLNTYNVVKAPQGKNQKSFVFILEPKQQGDPPVEFATDRVEELFEWFQSIREITWKIDTKENNMKYWEKNQSIAIELSDLVVYCKPTSKTKDNLENPDFREIRSFVETKADSIIRQKPVDLLKYNQKGLTRVYPKGQRVDSSNYDPFRLWLCGSQMVALNFQTADKYMQMNHALFSLNGRTGYVLQPESMRTEKYDPMPPESQRKILMTLTVKVLGARHLPKLGRSIACPFVEVEICGAEYDNNKFKTTVVNDNGLSPIWAPTQEKVTFEIYDPNLAFLRFVVYEEDMFSDPNFLAHATYPIKAVKSGFRSVPLKNGYSEDIELASLLVFCEMRPVLESEEELYSSCRQLRRRQEELNNQLFLYDTHQNLRNANRDALVKEFSVNENQSSCTRRNATRG

SEQ ID NO: 63362 - protein, 45 aa, Homo sapiens
  Payload ID: 12644
  Gene Symbol: PLCG2
  Gene Name: phospholipase C, gamma 2 (phosphatidylinositol-specific)
  ENSP ID: ENSP00000454536
  MOD_RES (1)..(1): Any amino acid
XDMQDMNNPLSHYWISSSHNTGLLGRARWEAGHLPWLDADYQDQV

SEQ ID NO: 63363 - protein, 178 aa, Homo sapiens
  Payload ID: 12644
  Gene Symbol: PLCG2
  Gene Name: phospholipase C, gamma 2 (phosphatidylinositol-specific)
  ENSP ID: ENSP00000455533
  MOD_RES (1)..(1): Any amino acid
XNTDRPDASAVYLHDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSRCPLSWVEVLL

SEQ ID NO: 63364 - protein, 159 aa, Homo sapiens
  Payload ID: 12644
  Gene Symbol: PLCG2
  Gene Name: phospholipase C, gamma 2 (phosphatidylinositol-specific)
  ENSP ID: ENSP00000455956
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRN

SEQ ID NO: 63365 - protein, 1265 aa, Homo sapiens
  Payload ID: 12644
  Gene Symbol: PLCG2
  Gene Name: phospholipase C, gamma 2 (phosphatidylinositol-specific)
  Uniprot ID: P16885
  ENSP ID: ENSP00000482457
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRNSISLRELKTILPLINFKVSSAKFLKDKFVEIGAHKDELSFEQFHLFYKKLMFEQQKSILDEFKKDSSVFILGNTDRPDASAVYLHDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSSFPVILSIEEHCSVEQQRHMAKAFKEVFGDLLLTKPTEASADQLPSPSQLREKIIIKHKKLGPRGDVDVNMEDKKDEHKQQGELYMWDSIDQKWTRHYCAIADAKLSFSDDIEQTMEEEVPQDIPPTELHFGEKWFHKKVEKRTSAEKLLQEYCMETGGKDGTFLVRESETFPNDYTLSFWRSGRVQHCRIRSTMEGGTLKYYLTDNLTFSSIYALIQHYRETHLRCAEFELRLTDPVPNPNPHESKPWYYDSLSRGEAEDMLMRIPRDGAFLIRKREGSDSYAITFRARGKVKHCRINRDGRHFVLGTSAYFESLVELVSYYEKHSLYRKMRLRYPVTPELLERYNMERDINSLYDVSRMYVDPSEINPSMPQRTVKALYDYKAKRSDELSFCRGALIHNVSKEPGGWWKGDYGTRIQQYFPSNYVEDISTADFEELEKQIIEDNPLGSLCRGILDLNTYNVVKAPQGKNQKSFVFILEPKQQGDPPVEFATDRVEELFEWFQSIREITWKIDTKENNMKYWEKNQSIAIELSDLVVYCKPTSKTKDNLENPDFREIRSFVETKADSIIRQKPVDLLKYNQKGLTRVYPKGQRVDSSNYDPFRLWLCGSQMVALNFQTADKYMQMNHALFSLNGRTGYVLQPESMRTEKYDPMPPESQRKILMTLTVKVLGARHLPKLGRSIACPFVEVEICGAEYDNNKFKTTVVNDNGLSPIWAPTQEKVTFEIYDPNLAFLRFVVYEEDMFSDPNFLAHATYPIKAVKSGFRSVPLKNGYSEDIELASLLVFCEMRPVLESEEELYSSCRQLRRRQEELNNQLFLYDTHQNLRNANRDALVKEFSVNENQLQLYQEKCNKRLREKRVSNSKFYS

SEQ ID NO: 63366 - protein, 608 aa, Homo sapiens
  Payload ID: 12645
  Gene Symbol: PLCZ1
  Gene Name: phospholipase C, zeta 1
  Uniprot ID: Q86YW0
  ENSP ID: ENSP00000266505
MEMRWFLSKIQDDFRGGKINLEKTQRLLEKLDIRCSYIHVKQIFKDNDRLKQGRITIEEFRAIYRIITHREEIIEIFNTYSENRKILLASNLAQFLTQEQYAAEMSKAIAFEIIQKYEPIEEVRKAHQMSLEGFTRYMDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 63367 - protein, 45 aa, Homo sapiens
  Payload ID: 12645
  Gene Symbol: PLCZ1
  Gene Name: phospholipase C, zeta 1
  ENSP ID: ENSP00000326397
MEMRWFLSKIQDDFRGGKINLEKTQRLLEKLDIRCSYIHVKQIFK

SEQ ID NO: 63368 - protein, 166 aa, Homo sapiens
  Payload ID: 12645
  Gene Symbol: PLCZ1
  Gene Name: phospholipase C, zeta 1
  ENSP ID: ENSP00000438629
MTAPTGERLLNSGLICSPFWKRELKQRGQIQDDFRGGKINLEKTQRLLEKLDIRCSYIHVKQIFKTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKK

SEQ ID NO: 63369 - protein, 101 aa, Homo sapiens
  Payload ID: 12645
  Gene Symbol: PLCZ1
  Gene Name: phospholipase C, zeta 1
  ENSP ID: ENSP00000438679
  MOD_RES (1)..(1): Any amino acid
XALNFQTPGLPMDLQNGKFLDNGGSGYILKPHFLRESKSYFNPSNIKEGMPITLTIRLISGIQLPLTHSSSNKGYRRIPLFSRMGESLEPASLFVYVWYVR

SEQ ID NO: 63370 - protein, 89 aa, Homo sapiens
  Payload ID: 12645
  Gene Symbol: PLCZ1
  Gene Name: phospholipase C, zeta 1
  ENSP ID: ENSP00000438826
MKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 63371 - protein, 53 aa, Homo sapiens
  Payload ID: 12645
  Gene Symbol: PLCZ1
  Gene Name: phospholipase C, zeta 1
  ENSP ID: ENSP00000440781
MEMRWFLSKIQDDFRGGKINLEKTQRLLEKLDIRCSYIHVKQIFKLGKHTKCH

SEQ ID NO: 63372 - protein, 412 aa, Homo sapiens
  Payload ID: 12645
  Gene Symbol: PLCZ1
  Gene Name: phospholipase C, zeta 1
  ENSP ID: ENSP00000443320
  MOD_RES (1)..(1): Any amino acid
XSLEGFTRYMDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNGQGNMVIIPA

SEQ ID NO: 63373 - protein, 131 aa, Homo sapiens
  Payload ID: 12645
  Gene Symbol: PLCZ1
  Gene Name: phospholipase C, zeta 1
  ENSP ID: ENSP00000443762
MADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKL

SEQ ID NO: 63374 - protein, 76 aa, Homo sapiens
  Payload ID: 12645
  Gene Symbol: PLCZ1
  Gene Name: phospholipase C, zeta 1
  ENSP ID: ENSP00000444383
MSKAIAFEIIQKYEPIEEVRKAHQMSLEGFTRYMDSRECLLFKNECRKVYQDMTHPLNDYFISSSHNTYLVSDQLL

SEQ ID NO: 63375 - protein, 45 aa, Homo sapiens; identical to SEQ ID NO: 63367
  Payload ID: 12645
  Gene Symbol: PLCZ1
  Gene Name: phospholipase C, zeta 1
  ENSP ID: ENSP00000444611

SEQ ID NO: 63376 - protein, 415 aa, Homo sapiens
  Payload ID: 12645
  Gene Symbol: PLCZ1
  Gene Name: phospholipase C, zeta 1
  Uniprot ID: Q86YW0
  ENSP ID: ENSP00000445026
MEMRWFLSKIQDDFRGGKINLEKTQRLLEKLDIRCSYIHVKQIFKTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 63377 - protein, 149 aa, Homo sapiens
  Payload ID: 12645
  Gene Symbol: PLCZ1
  Gene Name: phospholipase C, zeta 1
  ENSP ID: ENSP00000445287
DLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKASEMCLGNRSS

SEQ ID NO: 63378 - protein, 390 aa, Homo sapiens
  Payload ID: 12645
  Gene Symbol: PLCZ1
  Gene Name: phospholipase C, zeta 1
  ENSP ID: ENSP00000445880
MADNLQATFGESLLSDMLDDFPDTLPSPEALKFKILVKNKKIGTLKETHERKGSDKRGKVEEWEEEVADGEEEEEEEEEEEEEEEDKFKESEVLESVLGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 63379 - protein, 265 aa, Homo sapiens
  Payload ID: 12645
  Gene Symbol: PLCZ1
  Gene Name: phospholipase C, zeta 1
  ENSP ID: ENSP00000445889
GYTLTSKLLFKTVIQAIHKYAFMALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKN

SEQ ID NO: 63380 - protein, 1095 aa, Homo sapiens
  Payload ID: 12646
  Gene Symbol: PLCL1
  Gene Name: phospholipase C-like 1
  Uniprot ID: Q15111
  ENSP ID: ENSP00000402861
MAEGAAGREDPAPPDAAGGEDDPRVGPDAAGDCVTAASGGRMRDRRSGVALPGAAGTPADSEAGLLEAARATPRRSSIIKDPSNQKCGGRKKTVSFSSMPSEKKISSANDCISFMQAGCELKKVRPNSRIYNRFFTLDTDLQALRWEPSKKDLEKAKLDISAIKEIRLGKNTETFRNNGLADQICEDCAFSILHGENYESLDLVANSADVANIWVSGLRYLVSRSKQPLDFMEGNQNTPRFMWLKTVFEAADVDGNGIMLEDTSVELIKQLNPTLKEAKIRLKFKEIQKSKEKLTTRVTEEEFCEAFCELCTRPEVYFLLVQISKNKEYLDANDLMLFLEAEQGVTHITEDICLDIIRRYELSEEGRQKGFLAIDGFTQYLLSSECDIFDPEQKKVAQDMTQPLSHYYINASHNTYLIEDQFRGPADINGYIRALKMGCRSVELDVSDGSDNEPILCNRNNMTTHVSFRSVIEVINKFAFVASEYPLILCLGNHCSLPQQKVMAQQMKKVFGNKLYTEAPLPSESYLPSPEKLKRMIIVKGKKLPSDPDVLEGEVTDEDEEAEMSRRMSVDYNGEQKQIRLCRELSDLVSICKSVQYRDFELSMKSQNYWEMCSFSETEASRIANEYPEDFVNYNKKFLSRIYPSAMRIDSSNLNPQDFWNCGCQIVAMNFQTPGPMMDLHTGWFLQNGGCGYVLRPSIMRDEVSYFSANTKGILPGVSPLALHIKIISGQNFPKPKGACAKGDVIDPYVCIEIHGIPADCSEQRTKTVQQNSDNPIFDETFEFQVNLPELAMIRFVVLDDDYIGDEFIGQYTIPFECLQPGYRHVPLRSFVGDIMEHVTLFVHIAITNRSGGGKAQKRSLSVRMGKKVREYTMLRNIGLKTIDDIFKIAVHPLREAIDMRENMQNAIVSIKELCGLPPIASLKQCLLTLSSRLITSDNTPSVSLVMKDSFPYLEPLGAIPDVQKKMLTAYDLMIQESRFLIEMADTVQEKIVQCQKAGMEFHEELHNLGAKEGLKGRKLNKATESFAWNITVLKGQGDLLKNAKNEAIENMKQIQLACLSCGLSKAPSSSAEAKSKRSLEAIEEKESSEENGKL

SEQ ID NO: 63381 - protein, 94 aa, Homo sapiens
  Payload ID: 12646
  Gene Symbol: PLCL1
  Gene Name: phospholipase C-like 1
  ENSP ID: ENSP00000410488
MAEGAAGREDPAPPDAAGGEDDPRVGPDAAGDCVTAASGGRMRDRRSGVALPGAAGTPADSEAGLLEAARATPRRSSIIKMGLCSCRKTAQSFH

SEQ ID NO: 63382 - protein, 1018 aa, Homo sapiens [sequence omitted]

SEQ ID NO: 63383 - protein, 1012 aa, Homo sapiens
  Payload ID: 12646
  Gene Symbol: PLCL1
  Gene Name: phospholipase C-like 1
  ENSP ID: ENSP00000457588
MKNKLQDPSNQKCGGRKKTVSFSSMPSEKKISSANDCISFMQAGCELKKVRPNSRIYNRFFTLDTDLQALRWEPSKKDLEKAKLDISAIKEIRLGKNTETFRNNGLADQICEDCAFSILHGENYESLDLVANSADVANIWVSGLRYLVSRSKQPLDFMEGNQNTPRFMWLKTVFEAADVDGNGIMLEDTSVELIKQLNPTLKEAKIRLKFKEIQKSKEKLTTRVTEEEFCEAFCELCTRPEVYFLLVQISKNKEYLDANDLMLFLEAEQGVTHITEDICLDIIRRYELSEEGRQKGFLAIDGFTQYLLSSECDIFDPEQKKVAQDMTQPLSHYYINASHNTYLIEDQFRGPADINGYIRALKMGCRSVELDVSDGSDNEPILCNRNNMTTHVSFRSVIEVINKFAFVASEYPLILCLGNHCSLPQQKVMAQQMKKVFGNKLYTEAPLPSESYLPSPEKLKRMIIVKGKKLPSDPDVLEGEVTDEDEEAEMSRRMSVDYNGEQKQIRLCRELSDLVSICKSVQYRDFELSMKSQNYWEMCSFSETEASRIANEYPEDFVNYNKKFLSRIYPSAMRIDSSNLNPQDFWNCGCQIVAMNFQTPGPMMDLHTGWFLQNGGCGYVLRPSIMRDEVSYFSANTKGILPGVSPLALHIKIISGQNFPKPKGACAKGDVIDPYVCIEIHGIPADCSEQRTKTVQQNSDNPIFDETFEFQVNLPELAMIRFVVLDDDYIGDEFIGQYTIPFECLQPGYRHVPLRSFVGDIMEHVTLFVHIAITNRSGGGKAQKRSLSVRMGKKVREYTMLRNIGLKTIDDIFKIAVHPLREAIDMRENMQNAIVSIKELCGLPPIASLKQCLLTLSSRLITSDNTPSVSLVMKDSFPYLEPLGAIPDVQKKMLTAYDLMIQESRFLIEMADTVQEKIVQCQKAGMEFHEELHNLGAKEGLKGRKLNKATESFAWNITVLKGQGDLLKNAKNEAIENMKQIQLACLSCGLSKAPSSSAEAKSKRSLEAIEEK

SEQ ID NO: 63384 - protein, 704 aa, Homo sapiens
  Payload ID: 12647
  Gene Symbol: PLCL2
  Gene Name: phospholipase C-like 2
  ENSP ID: ENSP00000404433
  MOD_RES (1)..(1): Any amino acid
XIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSANTKDSVPGVSPQLLHIKIISGQNFPKPKGSGAKGDVVDPYVYVEIHGIPADCAEQRTKTVHQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKIRKTGRRSIFVPQTPIMV

SEQ ID NO: 63385 - protein, 1001 aa, Homo sapiens
  Payload ID: 12647
  Gene Symbol: PLCL2
  Gene Name: phospholipase C-like 2
  Uniprot ID: Q9UPR0
  ENSP ID: ENSP00000412836
MPTEKKISSASDCINSMVEGSELKKVRSNSRIYHRYFLLDADMQSLRWEPSKKDSEKAKIDIKSIKEVRTGKNTDIFRSNGISDQISEDCAFSVIYGENYESLDLVANSADVANIWVTGLRYLISYGKHTLDMLESSQDNMRTSWVSQMFSEIDVDNLGHITLCNAVQCIRNLNPGLKTSKIELKFKELHKSKDKAGTEVTKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSANTKDSVPGVSPQLLHIKIISGQNFPKPKGSGAKGDVVDPYVYVEIHGIPADCAEQRTKTVHQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKGQADLLKYAKNETLENLKQIHFAAVSCGLNKPGTENADVQKPRRSLEVIPEKANDETGE

SEQ ID NO: 63386 - protein, 1127 aa, Homo sapiens
  Payload ID: 12647
  Gene Symbol: PLCL2
  Gene Name: phospholipase C-like 2
  Uniprot ID: Q9UPR0
  ENSP ID: ENSP00000478458
MAECGRGGAAGGALPTSPGPALGAKGALKAGVGEGGGGGGRLGHGRARYDSGGVSNGDCSLGVSGDEARASPTRGPRGVALAPTPSAVVCTLPRESKPGGLPRRSSIIKDGTKQKRERKKTVSFSSMPTEKKISSASDCINSMVEGSELKKVRSNSRIYHRYFLLDADMQSLRWEPSKKDSEKAKIDIKSIKEVRTGKNTDIFRSNGISDQISEDCAFSVIYGENYESLDLVANSADVANIWVTGLRYLISYGKHTLDMLESSQDNMRTSWVSQMFSEIDVDNLGHITLCNAVQCIRNLNPGLKTSKIELKFKELHKSKDKAGTEVTKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSANTKDSVPGVSPQLLHIKIISGQNFPKPKGSGAKGDVVDPYVYVEIHGIPADCAEQRTKTVHQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKGQADLLKYAKNETLENLKQIHFAAVSCGLNKPGTENADVQKPRRSLEVIPEKANDETGE

SEQ ID NO: 63387 - protein, 490 aa, Homo sapiens
  Payload ID: 12648
  Gene Symbol: PLD3
  Gene Name: phospholipase D family, member 3
  Uniprot ID: Q8IV08
  ENSP ID: ENSP00000348901
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 63388 - protein, 177 aa, Homo sapiens
  Payload ID: 12648
  Gene Symbol: PLD3
  Gene Name: phospholipase D family, member 3
  ENSP ID: ENSP00000352220
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADL

SEQ ID NO: 63389 - protein, 128 aa, Homo sapiens
  Payload ID: 12648
  Gene Symbol: PLD3
  Gene Name: phospholipase D family, member 3
  ENSP ID: ENSP00000375886
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWT

SEQ ID NO: 63390 - protein, 490 aa, Homo sapiens; identical to SEQ ID NO: 63387
  Payload ID: 12648
  Gene Symbol: PLD3
  Gene Name: phospholipase D family, member 3
  Uniprot ID: Q8IV08
  ENSP ID: ENSP00000386293

SEQ ID NO: 63391 - protein, 490 aa, Homo sapiens; identical to SEQ ID NO: 63387
  Payload ID: 12648
  Gene Symbol: PLD3
  Gene Name: phospholipase D family, member 3
  Uniprot ID: Q8IV08
  ENSP ID: ENSP00000386938

SEQ ID NO: 63392 - protein, 490 aa, Homo sapiens; identical to SEQ ID NO: 63387
  Payload ID: 12648
  Gene Symbol: PLD3
  Gene Name: phospholipase D family, member 3
  Uniprot ID: Q8IV08
  ENSP ID: ENSP00000387022

SEQ ID NO: 63393 - protein, 490 aa, Homo sapiens; identical to SEQ ID NO: 63387
  Payload ID: 12648
  Gene Symbol: PLD3
  Gene Name: phospholipase D family, member 3
  Uniprot ID: Q8IV08
  ENSP ID: ENSP00000387050

SEQ ID NO: 63394 - protein, 81 aa, Homo sapiens
  Payload ID: 12648
  Gene Symbol: PLD3
  Gene Name: phospholipase D family, member 3
  ENSP ID: ENSP00000468898
MKPKLMYQELKVPAEEPANELPMNEIEAWKAAEKKARWVLLVLILAVVGFGALMTQLFLWEYGDLHLFGPNQRPAPCYDPC

SEQ ID NO: 63395 - protein, 119 aa, Homo sapiens
  Payload ID: 12648
  Gene Symbol: PLD3
  Gene Name: phospholipase D family, member 3
  ENSP ID: ENSP00000468999
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSS

SEQ ID NO: 63396 - protein, 70 aa, Homo sapiens
  Payload ID: 12648
  Gene Symbol: PLD3
  Gene Name: phospholipase D family, member 3
  ENSP ID: ENSP00000469675
MKPKLMYQELKVPAEEPANELPMNEIEAWKAAEKKARWVLLVLILAVVGFGALMTQLFLWEYGDLHLFGP

SEQ ID NO: 63397 - protein, 121 aa, Homo sapiens
  Payload ID: 12648
  Gene Symbol: PLD3
  Gene Name: phospholipase D family, member 3
  ENSP ID: ENSP00000469868
  MOD_RES (1)..(1): Any amino acid
XNQRPAPCYDPCDLSNTPMDGQLSTHLPALALRHRMADSIPHPPEQCWWKAFLRAWTSPMPPRGTLPPARPGWACSPVRTAAWTSPPSTGPSPTMTPTRRSPLPSRVRRSSGSCRPWHQRA

SEQ ID NO: 63398 - protein, 28 aa, Homo sapiens
  Payload ID: 12648
  Gene Symbol: PLD3
  Gene Name: phospholipase D family, member 3
  ENSP ID: ENSP00000470603
MKPKLMYQELKVPAEEPANELPMNEIEA

SEQ ID NO: 63399 - protein, 213 aa, Homo sapiens
  Payload ID: 12648
  Gene Symbol: PLD3
  Gene Name: phospholipase D family, member 3
  ENSP ID: ENSP00000471838
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFY

SEQ ID NO: 63400 - protein, 44 aa, Homo sapiens
  Payload ID: 12648
  Gene Symbol: PLD3
  Gene Name: phospholipase D family, member 3
  ENSP ID: ENSP00000472509
MKPKLMYQELKVPAEEPANELPMNEIEAWKAAEKKARWVLLVLI

SEQ ID NO: 63401 - protein, 111 aa, Homo sapiens
  Payload ID: 12648
  Gene Symbol: PLD3
  Gene Name: phospholipase D family, member 3
  ENSP ID: ENSP00000472854
  MOD_RES (1)..(1): Any amino acid
XSIPEGLDFPNASTGNPSTSQAWLGLLAGAHSSLDIASFYWTLTNNDTHTQEPSAQQGEEVLRQLQTLAPKGVNVRMVDMQKLTHGVLHTKFWVVDQTHFYLGSANMDWRS

SEQ ID NO: 63402 - protein, 71 aa, Homo sapiens
  Payload ID: 12648
  Gene Symbol: PLD3
  Gene Name: phospholipase D family, member 3
  ENSP ID: ENSP00000473218
  MOD_RES (1)..(1): Any amino acid
XVTERATYIGTSNWSGNYFTETAGTSLLVTQNGRGGLRSQLEAIFLRDWDSPYSHDLDTSADSVGNACRLL

SEQ ID NO: 63403 - protein, 506 aa, Homo sapiens
  Payload ID: 12649
  Gene Symbol: PLD4
  Gene Name: phospholipase D family, member 4
  Uniprot ID: Q96BZ4
  ENSP ID: ENSP00000376372
MLKPLWKAAVAPTWPCSMPPRRPWDREAGTLQVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLGEALLQKLQQLLGRNISLAVATSSPTLARTSTDLQVLAARGAHVRQVPMGRLTRGVLHSKFWVVDGRHIYMGSANMDWRSLTQVKELGAVIYNCSHLAQDLEKTFQTYWVLGVPKAVLPKTWPQNFSSHFNRFQPFHGLFDGVPTTAYFSASPPALCPQGRTRDLEALLAVMGSAQEFIYASVMEYFPTTRFSHPPRYWPVLDNALRAAAFGKGVRVRLLVGCGLNTDPTMFPYLRSLQALSNPAANVSVDVKVFIVPVGNHSNIPFSRVNHSKFMVTEKAAYIGTSNWSEDYFSSTAGVGLVVTQSPGAQPAGATVQEQLRQLFERDWSSRYAVGLDGQAPGQDCVWQG

SEQ ID NO: 63404 - protein, 513 aa, Homo sapiens
  Payload ID: 12649
  Gene Symbol: PLD4
  Gene Name: phospholipase D family, member 4
  ENSP ID: ENSP00000438677
MPGCPVQMLKPLWKAAVAPTWPCSMPPRRPWDREAGTLQVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLGEALLQKLQQLLGRNISLAVATSSPTLARTSTDLQVLAARGAHVRQVPMGRLTRGVLHSKFWVVDGRHIYMGSANMDWRSLTQVKELGAVIYNCSHLAQDLEKTFQTYWVLGVPKAVLPKTWPQNFSSHFNRFQPFHGLFDGVPTTAYFSASPPALCPQGRTRDLEALLAVMGSAQEFIYASVMEYFPTTRFSHPPRYWPVLDNALRAAAFGKGVRVRLLVGCGLNTDPTMFPYLRSLQALSNPAANVSVDVKVFIVPVGNHSNIPFSRVNHSKFMVTEKAAYIGTSNWSEDYFSSTAGVGLVVTQSPGAQPAGATVQEQLRQLFERDWSSRYAVGLDGQAPGQDCVWQG

SEQ ID NO: 63405 - protein, 257 aa, Homo sapiens
  Payload ID: 12649
  Gene Symbol: PLD4
  Gene Name: phospholipase D family, member 4
  ENSP ID: ENSP00000451278
MLKPLWKAAVAPTWPCSMPPRRPWDREAGTVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLGEALLQKLQQLLGRNISLAVATSSPTLARTSTDLQVLAARGAHVRQVPMGRLTRGVLHSKFWVVDGRHIYMGSANMDWRSLTQVKELGAVIYNCSHLAQDLEK

SEQ ID NO: 63406 - protein, 75 aa, Homo sapiens
  Payload ID: 12649
  Gene Symbol: PLD4
  Gene Name: phospholipase D family, member 4
  ENSP ID: ENSP00000451636
MVTEKAAYIGTSNWSEDYFSSTAGVGLVVTQSPGAQPAGATVQEQLRQLFERDWSSRYAVGLDGQAPGQDCVWQG

SEQ ID NO: 63407 - protein, 47 aa, Homo sapiens
  Payload ID: 12650
  Gene Symbol: PLD5
  Gene Name: phospholipase D family, member 5
  ENSP ID: ENSP00000314748
MSQQKCIVIFALVCCFAILVALIFSAVDIMGEDEDGLSEKNCQNKCR

SEQ ID NO: 63408 - protein, 109 aa, Homo sapiens
  Payload ID: 12650
  Gene Symbol: PLD5
  Gene Name: phospholipase D family, member 5
  ENSP ID: ENSP00000355503
MEIRQHEWLSASPHEGFEQMRLKSRPKEPSPSLTRVGANFYSSVKQQDYSASVWLRRKDKLEHSQQKCIVIFALVCCFAILVALIFSAVDIMGEDEDGLSEKNCQNKCR

SEQ ID NO: 63409 - protein, 474 aa, Homo sapiens
  Payload ID: 12650
  Gene Symbol: PLD5
  Gene Name: phospholipase D family, member 5
  Uniprot ID: Q8N7P1
  ENSP ID: ENSP00000401285
MSQQKCIVIFALVCCFAILVALIFSAVDIMGEDEDGLSEKNCQNKCRIALVENIPEGLNYSENAPFHLSLFQGWMNLLNMAKKSVDIVSSHWDLNHTHPSACQGQRLFEKLLQLTSQNIEIKLVSDVTADSKVLEALKLKGAEVTYMNMTAYNKGRLQSSFWIVDKQHVYIGSAGLDWQSLGQMKELGVIFYNCSCLVLDLQRIFALYSSLKFKSRVPQTWSKRLYGVYDNEKKLQLQLNETKSQAFVSNSPKLFCPKNRSFDIDAIYSVIDDAKQYVYIAVMDYLPISSTSTKRTYWPDLDAKIREALVLRSVRVRLLLSFWKETDPLTFNFISSLKAICTEIANCSLKVKFFDLERENACATKEQKNHTFPRLNRNKYMVTDGAAYIGNFDWVGNDFTQNAGTGLVINQADVRNNRSIIKQLKDVFERDWYSPYAKTLQPTKQPNCSSLFKLKPLSNKTATDDTGGKDPRNV

SEQ ID NO: 63410 - protein, 536 aa, Homo sapiens
  Payload ID: 12650
  Gene Symbol: PLD5
  Gene Name: phospholipase D family, member 5
  Uniprot ID: Q8N7P1
  ENSP ID: ENSP00000414188
MEIRQHEWLSASPHEGFEQMRLKSRPKEPSPSLTRVGANFYSSVKQQDYSASVWLRRKDKLEHSQQKCIVIFALVCCFAILVALIFSAVDIMGEDEDGLSEKNCQNKCRIALVENIPEGLNYSENAPFHLSLFQGWMNLLNMAKKSVDIVSSHWDLNHTHPSACQGQRLFEKLLQLTSQNIEIKLVSDVTADSKVLEALKLKGAEVTYMNMTAYNKGRLQSSFWIVDKQHVYIGSAGLDWQSLGQMKELGVIFYNCSCLVLDLQRIFALYSSLKFKSRVPQTWSKRLYGVYDNEKKLQLQLNETKSQAFVSNSPKLFCPKNRSFDIDAIYSVIDDAKQYVYIAVMDYLPISSTSTKRTYWPDLDAKIREALVLRSVRVRLLLSFWKETDPLTFNFISSLKAICTEIANCSLKVKFFDLERENACATKEQKNHTFPRLNRNKYMVTDGAAYIGNFDWVGNDFTQNAGTGLVINQADVRNNRSIIKQLKDVFERDWYSPYAKTLQPTKQPNCSSLFKLKPLSNKTATDDTGGKDPRNV

SEQ ID NO: 63411 - protein, 140 aa, Homo sapiens
  Payload ID: 12650
  Gene Symbol: PLD5
  Gene Name: phospholipase D family, member 5
  ENSP ID: ENSP00000438191
MSQQKCIVIFALVCCFAILVALIFSAVDIMGEDEDGLSEKNCQNKCRIALVENIPEGLNYSENAPFHLSLFQGWMNLLNMAKKSVDIVSSHWDLNHTHPSACQGQRLFEKLLQLTSQNIEIKLVSDVTADSKVLEALKLK

SEQ ID NO: 63412 - protein, 197 aa, Homo sapiens
  Payload ID: 12650
  Gene Symbol: PLD5
  Gene Name: phospholipase D family, member 5
  ENSP ID: ENSP00000440132
MEIRQHEWLSASPHEGFEQMRLKSRPKEPSPSLTRVGANFYSSVKQQDYSASVWLRRKDKLEHSQQKCIVIFALVCCFAILVALIFSAVDIMGEDEDGLSEKNCQNKCRIALVENIPEGLNYSENAPFHLSLFQGWMNLLNMAKKSVDIVSSHWDLNHTHPSACQGQRLFEKLLQLTSQNIEIKLVSDVTADSKEPR

SEQ ID NO: 63413 - protein, 536 aa, Homo sapiens; identical to SEQ ID NO: 63410
  Payload ID: 12650
  Gene Symbol: PLD5
  Gene Name: phospholipase D family, member 5
  Uniprot ID: Q8N7P1
  ENSP ID: ENSP00000440896

SEQ ID NO: 63414 - protein, 252 aa, Homo sapiens
  Payload ID: 12651
  Gene Symbol: PLD6
  Gene Name: phospholipase D family, member 6
  Uniprot ID: Q8N2A8
  ENSP ID: ENSP00000317177
MGRLSWQVAAAAAVGLALTLEALPWVLRWLRSRRRRPRREALFFPSQVTCTEALLRAPGAELAELPEGCPCGLPHGESALSRLLRALLAARASLDLCLFAFSSPQLGRAVQLLHQRGVRVRVVTDCDYMALNGSQIGLLRKAGIQVRHDQDPGYMHHKFAIVDKRVLITGSLNWTTQAIQNNRENVLITEDDEYVRLFLEEFERIWEQFNPTKYTFFPPKKSHGSCAPPVSRAGGRLLSWHRTCGTSSESQT

SEQ ID NO: 63415 - protein, 152 aa, Homo sapiens
  Payload ID: 12652
  Gene Symbol: PLD1
  Gene Name: phospholipase D1, phosphatidylcholine-specific
  ENSP ID: ENSP00000328422
MPGLVFFKFANLGGGWGSRKMLEPGMCPAEMSLTPFVTRSLNLLCFSVTHRGRGKDNPLHFFLQLLAPSASASLGLGRETGPLPSPGLSPGLLSETFVSEGPLLTLQISWCGTECLMDGQGPLIHLHSQNIRISFGATQPPLLLVYEIRWNR

SEQ ID NO: 63416 - protein, 1074 aa, Homo sapiens
  Payload ID: 12652
  Gene Symbol: PLD1
  Gene Name: phospholipase D1, phosphatidylcholine-specific
  Uniprot ID: Q13393
  ENSP ID: ENSP00000342793
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRWLIVKDSFLLYMKPDSGAIAFVLLVDKEFKIKVGKKETETKYGIRIDNLSRTLILKCNSYRHARWWGGAIEEFIQKHGTNFLKDHRFGSYAAIQENALAKWYVNAKGYFEDVANAMEEANEEIFITDWWLSPEIFLKRPVVEGNRWRLDCILKRKAQQGVRIFIMLYKEVELALGINSEYTKRTLMRLHPNIKVMRHPDHVSSTVYLWAHHEKLVIIDQSVAFVGGIDLAYGRWDDNEHRLTDVGSVKRVTSGPSLGSLPPAAMESMESLRLKDKNEPVQNLPIQKSIDDVDSKLKGIGKPRKFSKFSLYKQLHRHHLHDADSISSIDSTSSYFNHYRSHHNLIHGLKPHFKLFHPSSESEQGLTRPHADTGSIRSLQTGVGELHGETRFWHGKDYCNFVFKDWVQLDKPFADFIDRYSTPRMPWHDIASAVHGKAARDVARHFIQRWNFTKIMKSKYRSLSYPFLLPKSQTTAHELRYQVPGSVHANVQLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRVVLGYLDDPSEDIQDPVSDKFFKEVWVSTAARNATIYDKVFRCLPNDEVHNLIQLRDFINKPVLAKEDPIRAEEELKKIRGFLVQFPFYFLSEESLLPSVGTKEAIVPMEVWT

SEQ ID NO: 63417 - protein, 1036 aa, Homo sapiens
  Payload ID: 12652
  Gene Symbol: PLD1
  Gene Name: phospholipase D1, phosphatidylcholine-specific
  Uniprot ID: Q13393
  ENSP ID: ENSP00000348681
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRWLIVKDSFLLYMKPDSGAIAFVLLVDKEFKIKVGKKETETKYGIRIDNLSRTLILKCNSYRHARWWGGAIEEFIQKHGTNFLKDHRFGSYAAIQENALAKWYVNAKGYFEDVANAMEEANEEIFITDWWLSPEIFLKRPVVEGNRWRLDCILKRKAQQGVRIFIMLYKEVELALGINSEYTKRTLMRLHPNIKVMRHPDHVSSTVYLWAHHEKLVIIDQSVAFVGGIDLAYGRWDDNEHRLTDVGSVKRVTSGPSLGSLPPAAMESMESLRLKDKNEPVQNLPIQKSIDDVDSKLKGIGKPRKFSKFSLYKQLHRHHLHDADSISSIDSTSNTGSIRSLQTGVGELHGETRFWHGKDYCNFVFKDWVQLDKPFADFIDRYSTPRMPWHDIASAVHGKAARDVARHFIQRWNFTKIMKSKYRSLSYPFLLPKSQTTAHELRYQVPGSVHANVQLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRVVLGYLDDPSEDIQDPVSDKFFKEVWVSTAARNATIYDKVFRCLPNDEVHNLIQLRDFINKPVLAKEDPIRAEEELKKIRGFLVQFPFYFLSEESLLPSVGTKEAIVPMEVWT

SEQ ID NO: 63418 - protein, 57 aa, Homo sapiens
  Payload ID: 12652
  Gene Symbol: PLD1
  Gene Name: phospholipase D1, phosphatidylcholine-specific
  ENSP ID: ENSP00000391164
MSLKNEPRVNTSALQKIAADMSNIIENLDTRELHFEGEEVDYDVSPSDPKIQEGTKY

SEQ ID NO: 63419 - protein, 234 aa, Homo sapiens
  Payload ID: 12652
  Gene Symbol: PLD1
  Gene Name: phospholipase D1, phosphatidylcholine-specific
  ENSP ID: ENSP00000395556
  MOD_RES (1)..(1): Any amino acid
XHANVQLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRSKMTPGVEDP

SEQ ID NO: 63420 - protein, 141 aa, Homo sapiens
  Payload ID: 12652
  Gene Symbol: PLD1
  Gene Name: phospholipase D1, phosphatidylcholine-specific
  ENSP ID: ENSP00000400639
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPI

SEQ ID NO: 63421 - protein, 57 aa, Homo sapiens; identical to SEQ ID NO: 63418
  Payload ID: 12652
  Gene Symbol: PLD1
  Gene Name: phospholipase D1, phosphatidylcholine-specific
  ENSP ID: ENSP00000486967

SEQ ID NO: 63422 - protein, 933 aa, Homo sapiens
  Payload ID: 12653
  Gene Symbol: PLD2
  Gene Name: phospholipase D2
  Uniprot ID: O14939
  ENSP ID: ENSP00000263088
MTATPESLFPTGDELDSSQLQMESDEVDTLKEGEDPADRMHPFLAIYELQSLKVHPLVFAPGVPVTAQVVGTERYTSGSKVGTCTLYSVRLTHGDFSWTTKKKYRHFQELHRDLLRHKVLMSLLPLARFAVAYSPARDAGNREMPSLPRAGPEGSTRHAASKQKYLENYLNRLLTMSFYRNYHAMTEFLEVSQLSFIPDLGRKGLEGMIRKRSGGHRVPGLTCCGRDQVCYRWSKRWLVVKDSFLLYMCLETGAISFVQLFDPGFEVQVGKRSTEARHGVRIDTSHRSLILKCSSYRQARWWAQEITELAQGPGRDFLQLHRHDSYAPPRPGTLARWFVNGAGYFAAVADAILRAQEEIFITDWWLSPEVYLKRPAHSDDWRLDIMLKRKAEEGVRVSILLFKEVELALGINSGYSKRALMLLHPNIKVMRHPDQVTLWAHHEKLLVVDQVVAFLGGLDLAYGRWDDLHYRLTDLGDSSESAASQPPTPRPDSPATPDLSHNQFFWLGKDYSNLITKDWVQLDRPFEDFIDRETTPRMPWRDVGVVVHGLPARDLARHFIQRWNFTKTTKAKYKTPTYPYLLPKSTSTANQLPFTLPGGQCTTVQVLRSVDRWSAGTLENSILNAYLHTIRESQHFLYIENQFFISCSDGRTVLNKVGDEIVDRILKAHKQGWCYRVYVLLPLLPGFEGDISTGGGNSIQAILHFTYRTLCRGEYSILHRLKAAMGTAWRDYISICGLRTHGELGGHPVSELIYIHSKVLIADDRTVIIGSANINDRSLLGKRDSELAVLIEDTETEPSLMNGAEYQAGRFALSLRKHCFGVILGANTRPDLDLRDPICDDFFQLWQDMAESNANIYEQIFRCLPSNATRSLRTLREYVAVEPLATVSPPLARSELTQVQGHLVHFPLKFLEDESLLPPLGSKEGMIPLEVWT

SEQ ID NO: 63423 - protein, 172 aa, Homo sapiens
  Payload ID: 12653
  Gene Symbol: PLD2
  Gene Name: phospholipase D2
  ENSP ID: ENSP00000458795
MTATPESLFPTGDELDSSQLQMESDEVDTLKEGEDPADRMHPFLAIYELQSLKVHPLVFAPGVPVTAQVVGTERYTSGSKVGTCTLYSVRLTHGDFSWTTKKKYRHFQELHRDLLRHKVLMSLLPLARFAVAYSPARDAGNREMPSLPRAGPEGSTRHAASKQKYLENYLNR

SEQ ID NO: 63424 - protein, 128 aa, Homo sapiens
  Payload ID: 12653
  Gene Symbol: PLD2
  Gene Name: phospholipase D2
  ENSP ID: ENSP00000459304
MTATPESLFPTGDELDSSQLQMESDEVDTLKEGEDPADRMHPFLAIYELQSLKVHPLVFAPGVPVTAQVVGTERYTSGSKVGTCTLYSVRLTHGDFSWTTKKKYRHFQELHRDLLRHKVLMSLLPLAR

SEQ ID NO: 63425 - protein, 922 aa, Homo sapiens
  Payload ID: 12653
  Gene Symbol: PLD2
  Gene Name: phospholipase D2
  Uniprot ID: O14939
  ENSP ID: ENSP00000459571
MTATPESLFPTGDELDSSQLQMESDEVDTLKEGEDPADRMHPFLAIYELQSLKVHPLVFAPGVPVTAQVVGTERYTSGSKVGTCTLYSVRLTHGDFSWTTKKKYRHFQELHRDLLRHKVLMSLLPLARFAVAYSPARDAGNREMPSLPRAGPEGSTRHAASKQKYLENYLNRLLTMSFYRNYHAMTEFLEVSQLSFIPDLGRKGLEGMIRKRSGGHRVPGLTCCGRDQVCYRWSKRWLVVKDSFLLYMCLETGAISFVQLFDPGFEVQVGKRSTEARHGVRIDTSHRSLILKCSSYRQARWWAQEITELAQGPGRDFLQLHRHDSYAPPRPGTLARWFVNGAGYFAAVADAILRAQEEIFITDWWLSPEVYLKRPAHSDDWRLDIMLKRKAEEGVRVSILLFKEVELALGINSGYSKRALMLLHPNIKVMRHPDQVTLWAHHEKLLVVDQVVAFLGGLDLAYGRWDDLHYRLTDLGDSSESAASQPPTPRPDSPATPDLSHNQFFWLGKDYSNLITKDWVQLDRPFEDFIDRETTPRMPWRDVGVVVHGLPARDLARHFIQRWNFTKTTKAKYKTPTYPYLLPKSTSTANQLPFTLPGGQCTTVQVLRSVDRWSAGTLENSILNAYLHTIRESQHFLYIENQFFISCSDGRTVLNKVGDEIVDRILKAHKQGWCYRVYVLLPLLPGFEGDISTGGGNSIQAILHFTYRTLCRGEYSILHRLKAAMGTAWRDYISICGLRTHGELGGHPVSELIYIHSKVLIADDRTVIIGSANINDRSLLGKRDSELAVLIEDTETEPSLMNGAEYQAGSVILGANTRPDLDLRDPICDDFFQLWQDMAESNANIYEQIFRCLPSNATRSLRTLREYVAVEPLATVSPPLARSELTQVQGHLVHFPLKFLEDESLLPPLGSKEGMIPLEVWT

SEQ ID NO: 63426 - protein, 196 aa, Homo sapiens
  Payload ID: 12653
  Gene Symbol: PLD2
  Gene Name: phospholipase D2
  ENSP ID: ENSP00000460250
TTKAKYKTPTYPYLLPKSTSTANQLPFTLPGGQCTTVQNQFFISCSDGRTVLNKVGDEIVDRILKAHKQGWCYRVYVLLPLLPGFEGDISTGGGNSIQAILHFTYRTLCRGEYSILHRLKAAMGTAWRDYISICGLRTHGELGGHPVSELIYIHSKVLIADDRTVIIGSANINDRSLLGKRDSELAVLIEDTETEP

SEQ ID NO: 63427 - protein, 197 aa, Homo sapiens
  Payload ID: 12653
  Gene Symbol: PLD2
  Gene Name: phospholipase D2
  ENSP ID: ENSP00000460477
  MOD_RES (1)..(1): Any amino acid
XHFTYRTLCRGEYSILHRLKAAMGTAWRDYISICGLRTHGELGGHPVSELIYIHSKVLIADDRTVIIGSANINDRSLLGKRDSELAVLIEDTETEPSLMNGAEYQAGRFALSLRKHCFGVILGANTRPDLDLRDPICDDFFQLWQDMAESNANIYEQIFRCLPSNATRSLRTLREYVAVEPLATGPPSPLLPRWREG

SEQ ID NO: 63428 - protein, 48 aa, Homo sapiens
  Payload ID: 12653
  Gene Symbol: PLD2
  Gene Name: phospholipase D2
  ENSP ID: ENSP00000461459
  MOD_RES (1)..(1): Any amino acid
XILKCSSYRQARWWAQEITELAQGPGRDFLQLHRHDSYAPPRPGTLAR

SEQ ID NO: 63429 - protein, 285 aa, Homo sapiens
  Payload ID: 12654
  Gene Symbol: PLPP1
  Gene Name: phospholipid phosphatase 1
  Uniprot ID: O14494
  ENSP ID: ENSP00000264775
MFDKTRLPYVALDVLCVLLASMPMAVLKLGQIYPFQRGFFCKDNSINYPYHDSTVTSTVLILVGVGLPISSIILGETLSVYCNLLHSNSFIRNNYIATIYKAIGTFLFGAAASQSLTDIAKYSIGRLRPHFLDVCDPDWSKINCSDGYIEYYICRGNAERVKEGRLSFYSGHSSFSMYCMLFVALYLQARMKGDWARLLRPTLQFGLVAVSIYVGLSRVSDYKHHWSDVLTGLIQGALVAILVAVYVSDFFKERTSFKERKEEDSHTTLHETPTTGNHYPSNHQP

SEQ ID NO: 63430 - protein, 284 aa, Homo sapiens
  Payload ID: 12654
  Gene Symbol: PLPP1
  Gene Name: phospholipid phosphatase 1
  Uniprot ID: O14494
  ENSP ID: ENSP00000302229
MFDKTRLPYVALDVLCVLLAGLPFAILTSRHTPFQRGVFCNDESIKYPYKEDTIPYALLGGIIIPFSIIVIILGETLSVYCNLLHSNSFIRNNYIATIYKAIGTFLFGAAASQSLTDIAKYSIGRLRPHFLDVCDPDWSKINCSDGYIEYYICRGNAERVKEGRLSFYSGHSSFSMYCMLFVALYLQARMKGDWARLLRPTLQFGLVAVSIYVGLSRVSDYKHHWSDVLTGLIQGALVAILVAVYVSDFFKERTSFKERKEEDSHTTLHETPTTGNHYPSNHQP

SEQ ID NO: 63431 - protein, 110 aa, Homo sapiens
  Payload ID: 12654
  Gene Symbol: PLPP1
  Gene Name: phospholipid phosphatase 1
  ENSP ID: ENSP00000425052
MFDKTRLPYVALDVLCVLLASMPMAVLKLGQIYPFQRGFFCKDNSINYPYHDSTVTSTVLILVGVGLPISSLDCLLQFLLQGIPPSNEEYSVMMSPSSTLTKKTPYLMRY

SEQ ID NO: 63432 - protein, 232 aa, Homo sapiens
  Payload ID: 12655
  Gene Symbol: PLPP2
  Gene Name: phospholipid phosphatase 2
  Uniprot ID: O43688
  ENSP ID: ENSP00000269812
MAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 63433 - protein, 309 aa, Homo sapiens
  Payload ID: 12655
  Gene Symbol: PLPP2
  Gene Name: phospholipid phosphatase 2
  Uniprot ID: O43688
  ENSP ID: ENSP00000329697
MGVARGPGSRGQHPPPRQQEVCAEGPRARLHPAPPGLGASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 63434 - protein, 288 aa, Homo sapiens
  Payload ID: 12655
  Gene Symbol: PLPP2
  Gene Name: phospholipid phosphatase 2
  Uniprot ID: O43688
  ENSP ID: ENSP00000388565
MQRRWVFVLLDVLCLLVASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 63435 - protein, 178 aa, Homo sapiens
  Payload ID: 12655
  Gene Symbol: PLPP2
  Gene Name: phospholipid phosphatase 2
  ENSP ID: ENSP00000466545
MQRRWVFVLLDVLCLLVGFSSPPASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFG

SEQ ID NO: 63436 - protein, 136 aa, Homo sapiens
  Payload ID: 12655
  Gene Symbol: PLPP2
  Gene Name: phospholipid phosphatase 2
  ENSP ID: ENSP00000466947
  MOD_RES (1)..(1): Any amino acid
XVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVSF

SEQ ID NO: 63437 - protein, 208 aa, Homo sapiens
  Payload ID: 12655
  Gene Symbol: PLPP2
  Gene Name: phospholipid phosphatase 2
  ENSP ID: ENSP00000488312
MAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVCYISDFFKARPPQHCLKEEELERK

SEQ ID NO: 63438 - protein, 311 aa, Homo sapiens
  Payload ID: 12656
  Gene Symbol: PLPP3
  Gene Name: phospholipid phosphatase 3
  Uniprot ID: O14495
  ENSP ID: ENSP00000360296
MQNYKYDKAIVPESKNGGSPALNNNPRRSGSKRVLLICLDLFCLFMAGLPFLIIETSTIKPYHRGFYCNDESIKYPLKTGETINDAVLCAVGIVIAILAIITGEFYRIYYLKKSRSTIQNPYVAALYKQVGCFLFGCAISQSFTDIAKVSIGRLRPHFLSVCNPDFSQINCSEGYIQNYRCRGDDSKVQEARKSFFSGHASFSMYTMLYLVLYLQARFTWRGARLLRPLLQFTLIMMAFYTGLSRVSDHKHHPSDVLAGFAQGALVACCIVFFVSDLFKTKTTLSLPAPAIRKEILSPVDIIDRNNHHNMM

SEQ ID NO: 63439 - protein, 261 aa, Homo sapiens
  Payload ID: 12657
  Gene Symbol: PLPP4
  Gene Name: phospholipid phosphatase 4
  ENSP ID: ENSP00000358069
MHGIGPSGSFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGITEGPV

SEQ ID NO: 63440 - protein, 271 aa, Homo sapiens
  Payload ID: 12657
  Gene Symbol: PLPP4
  Gene Name: phospholipid phosphatase 4
  Uniprot ID: Q5VZY2
  ENSP ID: ENSP00000381302
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGITEGPV

SEQ ID NO: 63441 - protein, 267 aa, Homo sapiens
  Payload ID: 12657
  Gene Symbol: PLPP4
  Gene Name: phospholipid phosphatase 4
  ENSP ID: ENSP00000407979
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGIT

SEQ ID NO: 63442 - protein, 216 aa, Homo sapiens
  Payload ID: 12658
  Gene Symbol: PLPP5
  Gene Name: phospholipid phosphatase 5
  Uniprot ID: Q8NEB5
  ENSP ID: ENSP00000390622
MGKAAAAVAFGAEVGVRLALFAAFLVTELLPPFQRLIQPEEMWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSFAFAGLAFASFYLAGKLHCFTPQGRGKSWRFCAFLSPLLFAAVIALSRTCDYKHHWQGPFKW

SEQ ID NO: 63443 - protein, 264 aa, Homo sapiens [sequence omitted]

SEQ ID NO: 63444 - protein, 176 aa, Homo sapiens
  Payload ID: 12658
  Gene Symbol: PLPP5
  Gene Name: phospholipid phosphatase 5
  Uniprot ID: Q8NEB5
  ENSP ID: ENSP00000414522
MGKAAAAVAFGAEVGVRLALFAAFLVTELLPPFQRLIQPEEMWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSCMNIIWTLPYACFHIIEFNLES

SEQ ID NO: 63445 - protein, 244 aa, Homo sapiens
  Payload ID: 12658
  Gene Symbol: PLPP5
  Gene Name: phospholipid phosphatase 5
  ENSP ID: ENSP00000431771
  MOD_RES (1)..(1): Any amino acid
XVAFGAEVGVRLALFAAFLVTELLPPFQRLIQPEEMWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSWKLHCFTPQGRGKSWRFCAFLSPLLFAAVIALSRTCDYKHHWQDVLVGSMIGMTFAYVCYRQYYPPLTDAECHKPFQDKLVLSTAQKPGDSYCFDI

SEQ ID NO: 63446 - protein, 245 aa, Homo sapiens
  Payload ID: 12658
  Gene Symbol: PLPP5
  Gene Name: phospholipid phosphatase 5
  ENSP ID: ENSP00000432122
GKAAAAVAFGAEVGVRLALFAAFLVTELLPPFQRLIQPEEMWLYRNPYVEAEYFPTKPMFKADTRDSRQACLAASLALALNGVFTNTIKLIVGRPRPDFFYRCFPDGLAHSDLMCTGDKDVVNEGRKSFPSGHSSFAFAGLAFASFYLAGKLHCFTPQGRGKSWRFCAFLSPLLFAAVIALSRTCDYKHHWQDVLVGSMIGMTFAYVCYRQYYPPLTDAECHKPFQDKLVLSTAQKPGDSYCFDI

SEQ ID NO: 63447 - protein, 60 aa, Homo sapiens
  Payload ID: 12658
  Gene Symbol: PLPP5
  Gene Name: phospholipid phosphatase 5
  ENSP ID: ENSP00000434555
AFGAEVGVRLALFAAFLVTELLPPFQRLIQPEEMWLYRNPYVEAEYFPTKPMFLPALPWL

SEQ ID NO: 63448 - protein, 223 aa, Homo sapiens
  Payload ID: 12658
  Gene Symbol: PLPP5
  Gene Name: phospholipid phosphatase 5
  Uniprot ID: Q8NEB5
  ENSP ID: ENSP00000434916
MWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSFAFAGLAFASFYLAGKLHCFTPQGRGKSWRFCAFLSPLLFAAVIALSRTCDYKHHWQDVLVGSMIGMTFAYVCYRQYYPPLTDAECHKPFQDKLVLSTAQKPGDSYCFDI

SEQ ID NO: 63449 - protein, 132 aa, Homo sapiens
  Payload ID: 12658
  Gene Symbol: PLPP5
  Gene Name: phospholipid phosphatase 5
  ENSP ID: ENSP00000437248
MCTGDKDVVNEGRKSFPSGHSSFAFAGLAFASFYLAGKLHCFTPQGRGKSWRFCAFLSPLLFAAVIALSRTCDYKHHWQDVLVGSMIGMTFAYVCYRQYYPPLTDAECHKPFQDKLVLSTAQKPGDSYCFDI

SEQ ID NO: 63450 - protein, 295 aa, Homo sapiens
  Payload ID: 12659
  Gene Symbol: PLPP6
  Gene Name: phospholipid phosphatase 6
  Uniprot ID: Q8IY26
  ENSP ID: ENSP00000371307
MPSPRRSMEGRPLGVSASSSSSSPGSPAHGGGGGGSRFEFQSLLSSRATAVDPTCARLRASESPVHRRGSFPLAAAGPSQSPAPPLPEEDRMDLNPSFLGIALRSLLAIDLWLSKKLGVCAGESSSWGSVRPLMKLLEISGHGIPWLLGTLYCLCRSDSWAGREVLMNLLFALLLDLLLVALIKGLVRRRRPAHNQMDMFVTLSVDKYSFPSGHATRAALMSRFILNHLVLAIPLRVLVVLWAFVLGLSRVMLGRHNVTDVAFGFFLGYMQYSIVDYCWLSPHNAPVLFLLWSQR

SEQ ID NO: 63451 - protein, 151 aa, Homo sapiens
  Payload ID: 12660
  Gene Symbol: PLPP7
  Gene Name: phospholipid phosphatase 7 (inactive)
  ENSP ID: ENSP00000361335
MPASQSRARARDRNNVLNRAEFLSLNQPPKGGPEPRSSGRKASGPSAQPPPAGDGARERRQSQQLPEEDCMQLNPSFKGIAFNSLLAIDICMSKRLGVCAGRAASWASARSMVKLIGITGHGIPWIGGTILCLVKSSTLAGQEVLMNLLLD

SEQ ID NO: 63452 - protein, 271 aa, Homo sapiens
  Payload ID: 12660
  Gene Symbol: PLPP7
  Gene Name: phospholipid phosphatase 7 (inactive)
  Uniprot ID: Q8NBV4
  ENSP ID: ENSP00000361338
MPASQSRARARDRNNVLNRAEFLSLNQPPKGGPEPRSSGRKASGPSAQPPPAGDGARERRQSQQLPEEDCMQLNPSFKGIAFNSLLAIDICMSKRLGVCAGRAASWASARSMVKLIGITGHGIPWIGGTILCLVKSSTLAGQEVLMNLLLALLLDIMTVAGVQKLIKRRGPYETSPSLLDYLTMDIYAFPAGHASRAAMVSKFFLSHLVLAVPLRVLLVLWALCVGLSRVMIGRHHVTDVLSGFVIGYLQFRLVELVWMPSSTCQMLISAW

SEQ ID NO: 63453 - protein, 325 aa, Homo sapiens
  Payload ID: 12661
  Gene Symbol: PLPPR1
  Gene Name: phospholipid phosphatase related 1
  Uniprot ID: Q8TBJ4
  ENSP ID: ENSP00000364008
MAVGNNTQRSYSIIPCFIFVELVIMAGTVLLAYYFECTDTFQVHIQGFFCQDGDLMKPYPGTEEESFITPLVLYCVLAATPTAIIFIGEISMYFIKSTRESLIAQEKTILTGECCYLNPLLRRIIRFTGVFAFGLFATDIFVNAGQVVTGHLTPYFLTVCKPNYTSADCQAHHQFINNGNICTGDLEVIEKARRSFPSKHAALSIYSALYATMYITSTIKTKSSRLAKPVLCLGTLCTAFLTGLNRVSEYRNHCSDVIAGFILGTAVALFLGMCVVHNFKGTQGSPSKPKPEDPRGVPLMAFPRIESPLETLSAQNHSASMTEVT

SEQ ID NO: 63454 - protein, 325 aa, Homo sapiens; identical to SEQ ID NO: 63453
  Payload ID: 12661
  Gene Symbol: PLPPR1
  Gene Name: phospholipid phosphatase related 1
  Uniprot ID: Q8TBJ4
  ENSP ID: ENSP00000378496

SEQ ID NO: 63455 - protein, 103 aa, Homo sapiens
  Payload ID: 12661
  Gene Symbol: PLPPR1
  Gene Name: phospholipid phosphatase related 1
  ENSP ID: ENSP00000410223
MAVGNNTQRSYSIIPCFIFVELVIMAGTVLLAYYFECTDTFQVHIQGFFCQDGDLMKPYPGTEEESFITPLVLYCVLAATPTAIIFIGEISMYFIKSTRESLI

SEQ ID NO: 63456 - protein, 325 aa, Homo sapiens; identical to SEQ ID NO: 63453
  Payload ID: 12661
  Gene Symbol: PLPPR1
  Gene Name: phospholipid phosphatase related 1
  Uniprot ID: Q8TBJ4
  ENSP ID: ENSP00000477959

SEQ ID NO: 63457 - protein, 325 aa, Homo sapiens; identical to SEQ ID NO: 63453
  Payload ID: 12661
  Gene Symbol: PLPPR1
  Gene Name: phospholipid phosphatase related 1
  Uniprot ID: Q8TBJ4
  ENSP ID: ENSP00000478338

SEQ ID NO: 63458 - protein, 103 aa, Homo sapiens; identical to SEQ ID NO: 63455
  Payload ID: 12661
  Gene Symbol: PLPPR1
  Gene Name: phospholipid phosphatase related 1
  ENSP ID: ENSP00000488301

SEQ ID NO: 63459 - protein, 228 aa, Homo sapiens
  Payload ID: 12661
  Gene Symbol: PLPPR1
  Gene Name: phospholipid phosphatase related 1
  ENSP ID: ENSP00000488839
MLYFQLVIMAGTVLLAYYFECTDTFQVHIQGFFCQDGDLMKPYPGTEEESFITPLVLYCVLAATPTAIIFIGEISMYFIKSTRESLIAQEKTILTGECCYLNPLLRRIIRFTGVFAFGLFATDIFVNAGQVVTGHLTPYFLTVCKPNYTSADCQAHHQFINNGNICTGDLEVIEKARRSFPSKHAALSIYSALYATMYITSTIKTKSSRLAKPVLCLGTLCTAFLTGL

SEQ ID NO: 63460 - protein, 343 aa, Homo sapiens
  Payload ID: 12662
  Gene Symbol: PLPPR2
  Gene Name: phospholipid phosphatase related 2
  Uniprot ID: Q96GM1
  ENSP ID: ENSP00000251473
MAGGRPHLKRSFSIIPCFVFVESVLLGIVILLAYRLEFTDTFPVHTQGFFCYDSTYAKPYPGPEAASRVPPALVYALVTAGPTLTILLGELARAFFPAPPSAVPVIGESTIVSGACCRFSPPVRRLVRFLGVYSFGLFTTTIFANAGQVVTGNPTPHFLSVCRPNYTALGCLPPSPDRPGPDRFVTDQGACAGSPSLVAAARRAFPCKDAALCAYAVTYTAMYVTLVFRVKGSRLVKPSLCLALLCPAFLVGVVRVAEYRNHWSDVLAGFLTGAAIATFLVTCVVHNFQSRPPSGRRLSPWEDLGQAPTMDSPLEKNPRSAGRIRHRHGSPHPSRRTAPAVAT

SEQ ID NO: 63461 - protein, 66 aa, Homo sapiens
  Payload ID: 12662
  Gene Symbol: PLPPR2
  Gene Name: phospholipid phosphatase related 2
  ENSP ID: ENSP00000466698
MAGGRPHLKRSFSIIPCFVFVEGFFCYDSTYAKPYPGPEAASRVPPALVYALVTAGPTLTILLGEL

SEQ ID NO: 63462 - protein, 427 aa, Homo sapiens
  Payload ID: 12662
  Gene Symbol: PLPPR2
  Gene Name: phospholipid phosphatase related 2
  ENSP ID: ENSP00000466898
MAGGRPHLKRSFSIIPCFVFVEGFFCYDSTYAKPYPGPEAASRVPPALVYALVTAGPTLTILLGELARAFFPAPPSAVPVIGESTIVSGACCRFSPPVRRLVRFLGVYSFGLFTTTIFANAGQVVTGNPTPHFLSVCRPNYTALGCLPPSPDRPGPDRFVTDQGACAGSPSLVAAARRAFPCKDAALCAYAVTYTAMYVTLVFRVKGSRLVKPSLCLALLCPAFLVGVVRVAEYRNHWSDVLAGFLTGAAIATFLVTCVVHNFQSRPPSGRRLSPWEDLGQAPTMDSPLEKLSVAQEPEVCRPHSTPARLTPSKSQNCARRGHLIPSCVSSRAPAMCSSPRVPRPRLRSEPTPLPLPLPLPAPTPSQGPSPSSPGPGGPGGGGGRGRKLLLPTPLLRDLYTLSGLYPSPFHRDNFSPYLFASRDHLL

SEQ ID NO: 63463 - protein, 84 aa, Homo sapiens
  Payload ID: 12662
  Gene Symbol: PLPPR2
  Gene Name: phospholipid phosphatase related 2
  ENSP ID: ENSP00000467807
MAGGRPHLKRSFSIIPCFVFVESVLLGIVILLAYRLEFTDTFPVHTQGFFCYDSTYAKPYPGPEAASRVPPALVYALVTAGPTL

SEQ ID NO: 63464 - protein, 746 aa, Homo sapiens
  Payload ID: 12663
  Gene Symbol: PLPPR3
  Gene Name: phospholipid phosphatase related 3
  ENSP ID: ENSP00000352962
MISTKEKNKIPKDSMTLLPCFYFVELPIVASSIVSLYFLELTDLFKPAKVGFQCYDRTLSMPYVETNEELIPLLMLLSLAFAAPAASIMVAEGMLYCLQSRLWGRAGGPAGAEGSINAGGCNFNSFLRRTVRFVGVHVFGLCATALVTDVIQLATGYHTPFFLTVCKPNYTLLGTSCEVNPYITQDICSGHDIHAILSARKTFPSQHATLSAFAAVYVSVSPAPHCPSQALLLTRGEPSLTPTPMPQMYFNSVISDTTKLLKPILVFAFAIAAGVCGLTQITQYRSHPVDVYAGFLIGAGIAAYLACHAVGNFQAPPAEKPAAPAPAKDALRALTQRGHDSVYQQNKSVSTDELGPPGRLEGAPRPVAREKTSLGSLKRASVDVDLLAPRSPMAKENMVTFSHTLPRASAPSLDDPARRHMTIHVPLDASRSKQLISEWKQKSLEGRGLGLPDDASPGHLRAPAEPMAEEEEEEEDEEEEEEEEEEEDEGPAPPSLYPTVQARPGLGPRVILPPRAGPPPLVHIPEEGAQTGAGLSPKSGAGVRAKWLMMAEKSGAAVANPPRLLQVIAMSKAPGAPGPKAAETASSSSASSDSSQYRSPSDRDSASIVTIDAHAPHHPVVHLSAGGAPWEWKAAGGGAKAEADGGYELGDLARGFRGGAKPPGVSPGSSVSDVDQEEPRFGAVATVNLATGEGLPPLGAADGALGPGSRESTLRRHAGGLGLAEREAEAEAEGYFRKMQARRFPD

SEQ ID NO: 63465 - protein, 718 aa, Homo sapiens
  Payload ID: 12663
  Gene Symbol: PLPPR3
  Gene Name: phospholipid phosphatase related 3
  Uniprot ID: Q6T4P5
  ENSP ID: ENSP00000430297
MISTKEKNKIPKDSMTLLPCFYFVELPIVASSIVSLYFLELTDLFKPAKVGFQCYDRTLSMPYVETNEELIPLLMLLSLAFAAPAASIMVAEGMLYCLQSRLWGRAGGPAGAEGSINAGGCNFNSFLRRTVRFVGVHVFGLCATALVTDVIQLATGYHTPFFLTVCKPNYTLLGTSCEVNPYITQDICSGHDIHAILSARKTFPSQHATLSAFAAVYVSMYFNSVISDTTKLLKPILVFAFAIAAGVCGLTQITQYRSHPVDVYAGFLIGAGIAAYLACHAVGNFQAPPAEKPAAPAPAKDALRALTQRGHDSVYQQNKSVSTDELGPPGRLEGAPRPVAREKTSLGSLKRASVDVDLLAPRSPMAKENMVTFSHTLPRASAPSLDDPARRHMTIHVPLDASRSKQLISEWKQKSLEGRGLGLPDDASPGHLRAPAEPMAEEEEEEEDEEEEEEEEEEEDEGPAPPSLYPTVQARPGLGPRVILPPRAGPPPLVHIPEEGAQTGAGLSPKSGAGVRAKWLMMAEKSGAAVANPPRLLQVIAMSKAPGAPGPKAAETASSSSASSDSSQYRSPSDRDSASIVTIDAHAPHHPVVHLSAGGAPWEWKAAGGGAKAEADGGYELGDLARGFRGGAKPPGVSPGSSVSDVDQEEPRFGAVATVNLATGEGLPPLGAADGALGPGSRESTLRRHAGGLGLAEREAEAEAEGYFRKMQARRFPD

SEQ ID NO: 63466 - protein, 120 aa, Homo sapiens
  Payload ID: 12663
  Gene Symbol: PLPPR3
  Gene Name: phospholipid phosphatase related 3
  ENSP ID: ENSP00000430544
DIHAILSARKTFPSQHATLSAFAAVYVSLLKPILVFAFAIAAGVCGLTQITQYRSHPVDVYAGFLIGAGIAAYLACHAVGNFQAPPAEKPAAPAPAKDALRALTQRGHDSVYQQNKSVST

SEQ ID NO: 63467 - protein, 128 aa, Homo sapiens
  Payload ID: 12663
  Gene Symbol: PLPPR3
  Gene Name: phospholipid phosphatase related 3
  ENSP ID: ENSP00000466122
MISTKEKNKIPKDSMTLLPCFYFVELPIVASSIVSLYFLELTDLFKPAKVGFQCYDRTLSMPYVETNEELIPLLMLLSLAFAAPAASIMVAEGMLYCLQSRLWGRAGGPAGAEGSINAGGCNFNSFLR

SEQ ID NO: 63468 - protein, 25 aa, Homo sapiens
  Payload ID: 12663
  Gene Symbol: PLPPR3
  Gene Name: phospholipid phosphatase related 3
  ENSP ID: ENSP00000487866
MISTKEKNKIPKDSMTLLPCFYFVE

SEQ ID NO: 63469 - protein, 25 aa, Homo sapiens
  Payload ID: 12663
  Gene Symbol: PLPPR3
  Gene Name: phospholipid phosphatase related 3
  ENSP ID: ENSP00000488138
MISTKEKNKIPKDSMTLLPCFYFVE

SEQ ID NO: 63470 - protein, 25 aa, Homo sapiens
  Payload ID: 12663
  Gene Symbol: PLPPR3
  Gene Name: phospholipid phosphatase related 3
  ENSP ID: ENSP00000488788
MISTKEKNKIPKDSMTLLPCFYFVE

SEQ ID NO: 63471 - protein, 605 aa, Homo sapiens
  Payload ID: 12664
  Gene Symbol: PLPPR4
  Gene Name: phospholipid phosphatase related 4
  ENSP ID: ENSP00000359203
MNMFDADTTTNLVTISFILPIGVHVFGLCSTALITDIIQLSTGYQAPYFLTVCKPNYTSLNVSCKENSYIVEDICSGSDLTVINSGRKSFPSQHATLAAFAAVYVSMYFNSTLTDSSKLLKPLLVFTFIICGIICGLTRITQYKNHPVDVYCGFLIGGGIALYLGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 63472 - protein, 763 aa, Homo sapiens
  Payload ID: 12664
  Gene Symbol: PLPPR4
  Gene Name: phospholipid phosphatase related 4
  Uniprot ID: Q7Z2D5
  ENSP ID: ENSP00000359204
MQRAGSSGGRGECDISGAGRLGLEEAARLSCAVHTSPGGGRRPGQAAGMSAKERPKGKVIKDSVTLLPCFYFVELPILASSVVSLYFLELTDVFKPVHSGFSCYDRSLSMPYIEPTQEAIPFLMLLSLAFAGPAITIMVGEGILYCCLSKRRNGVGLEPNINAGGCNFNSFLRRAVRFVGVHVFGLCSTALITDIIQLSTGYQAPYFLTVCKPNYTSLNVSCKENSYIVEDICSGSDLTVINSGRKSFPSQHATLAAFAAVYVSMYFNSTLTDSSKLLKPLLVFTFIICGIICGLTRITQYKNHPVDVYCGFLIGGGIALYLGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 63473 - protein, 705 aa, Homo sapiens
  Payload ID: 12664
  Gene Symbol: PLPPR4
  Gene Name: phospholipid phosphatase related 4
  ENSP ID: ENSP00000394913
MQRAGSSGGRGECDISGAGRLGLEEAARLSCAVHTSPGGGRRPGQAAGMSAKERPKGKVIKDSVTLLPCFYFVELPILASSVVSLYFLELTDVFKPVHSGFSCYDRSLSMPYIEPTQEAIPFLMLLSLAFAGPAITIMVGEGILYCCLSKRRNGVGLEPNINAGGCNFNSFLRRAVRFVGVHVFGLCSTALITDIIQLSTGYQAPYFLTVCKPNYTSLNVSCKENSYIVEDICSGSDLTVINSGRKSFPSQHATLAAFAAVYVSGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 63474 - protein, 321 aa, Homo sapiens
  Payload ID: 12665
  Gene Symbol: PLPPR5
  Gene Name: phospholipid phosphatase related 5
  Uniprot ID: Q32ZL2
  ENSP ID: ENSP00000263177
MPLLPAALTSSMLYFQMVIMAGTVMLAYYFEYTDTFTVNVQGFFCHDSAYRKPYPGPEDSSAVPPVLLYSLAAGVPVLVIIVGETAVFCLQLATRDFENQEKTILTGDCCYINPLVRRTVRFLGIYTFGLFATDIFVNAGQVVTGNLAPHFLALCKPNYTALGCQQYTQFISGEEACTGNPDLIMRARKTFPSKEAALSVYAAMYLTMYITNTIKAKGTRLAKPVLCLGLMCLAFLTGLNRVAEYRNHWSDVIAGFLVGISIAVFLVVCVVNNFKGRQAENEHIHMDNLAQMPMISIPRVESPLEKVTSVQNHITAFAEVT

SEQ ID NO: 63475 - protein, 316 aa, Homo sapiens
  Payload ID: 12665
  Gene Symbol: PLPPR5
  Gene Name: phospholipid phosphatase related 5
  ENSP ID: ENSP00000359207
MPLLPAALTSSMLYFQMVIMAGTVMLAYYFEYTDTFTVNVQGFFCHDSAYRKPYPGPEDSSAVPPVLLYSLAAGVPVLVIIVGETAVFCLQLATRDFENQEKTILTGDCCYINPLVRRTVRFLGIYTFGLFATDIFVNAGQVVTGNLAPHFLALCKPNYTALGCQQYTQFISGEEACTGNPDLIMRARKTFPSKEAALSVYAAMYLTMYITNTIKAKGTRLAKPVLCLGLMCLAFLTGLNRVAEYRNHWSDVIAGFLVGISIAVFLVVCVVNNFKGRQAENEHIHMDNLAQMPMISIPRVESPLEKNHITAFAEVT

SEQ ID NO: 63476 - protein, 318 aa, Homo sapiens
  Payload ID: 12666
  Gene Symbol: PLSCR1
  Gene Name: phospholipid scramblase 1
  Uniprot ID: O15162
  ENSP ID: ENSP00000345494
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 63477 - protein, 237 aa, Homo sapiens
  Payload ID: 12666
  Gene Symbol: PLSCR1
  Gene Name: phospholipid scramblase 1
  Uniprot ID: O15162
  ENSP ID: ENSP00000411675
MLLTRKQTCQLGILLSIHRQHSKIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 63478 - protein, 41 aa, Homo sapiens
  Payload ID: 12666
  Gene Symbol: PLSCR1
  Gene Name: phospholipid scramblase 1
  ENSP ID: ENSP00000417469
MDKQNSQMNASHPETNLPVGYPPQYPPTAFQDRSDTDSSAN

SEQ ID NO: 63479 - protein, 41 aa, Homo sapiens; identical to SEQ ID NO: 63478
  Payload ID: 12666
  Gene Symbol: PLSCR1
  Gene Name: phospholipid scramblase 1
  ENSP ID: ENSP00000417588

SEQ ID NO: 63480 - protein, 41 aa, Homo sapiens; identical to SEQ ID NO: 63478
  Payload ID: 12666
  Gene Symbol: PLSCR1
  Gene Name: phospholipid scramblase 1
  ENSP ID: ENSP00000417733

SEQ ID NO: 63481 - protein, 311 aa, Homo sapiens
  Payload ID: 12666
  Gene Symbol: PLSCR1
  Gene Name: phospholipid scramblase 1
  ENSP ID: ENSP00000417792
MNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 63482 - protein, 248 aa, Homo sapiens
  Payload ID: 12666
  Gene Symbol: PLSCR1
  Gene Name: phospholipid scramblase 1
  ENSP ID: ENSP00000418103
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFT

SEQ ID NO: 63483 - protein, 171 aa, Homo sapiens
  Payload ID: 12666
  Gene Symbol: PLSCR1
  Gene Name: phospholipid scramblase 1
  ENSP ID: ENSP00000418550
MLLTRKQTCQLGILLSIHRQHSKIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDE

SEQ ID NO: 63484 - protein, 41 aa, Homo sapiens; identical to SEQ ID NO: 63478
  Payload ID: 12666
  Gene Symbol: PLSCR1
  Gene Name: phospholipid scramblase 1
  ENSP ID: ENSP00000418654

SEQ ID NO: 63485 - protein, 41 aa, Homo sapiens; identical to SEQ ID NO: 63478
  Payload ID: 12666
  Gene Symbol: PLSCR1
  Gene Name: phospholipid scramblase 1
  ENSP ID: ENSP00000419228

SEQ ID NO: 63486 - protein, 41 aa, Homo sapiens; identical to SEQ ID NO: 63478
  Payload ID: 12666
  Gene Symbol: PLSCR1
  Gene Name: phospholipid scramblase 1
  ENSP ID: ENSP00000419680

SEQ ID NO: 63487 - protein, 171 aa, Homo sapiens
  Payload ID: 12666
  Gene Symbol: PLSCR1
  Gene Name: phospholipid scramblase 1
  ENSP ID: ENSP00000420006
  MOD_RES (1)..(1): Any amino acid
XGFPVPNQPVYNQPVYNQPVGAAGVPWMPAPQPPLNCPPGLEYLSQIDQILIHQQIELLEEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMF

SEQ ID NO: 63488 - protein, 249 aa, Homo sapiens
  Payload ID: 12666
  Gene Symbol: PLSCR1
  Gene Name: phospholipid scramblase 1
  ENSP ID: ENSP00000420523
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKS

SEQ ID NO: 63489 - protein, 224 aa, Homo sapiens
  Payload ID: 12667
  Gene Symbol: PLSCR2
  Gene Name: phospholipid scramblase 2
  Uniprot ID: Q9NRY7
  ENSP ID: ENSP00000338707
MPAPPPPLNCPPGLEYLSQIDMILIHQQIELLEVLFSFESSNMYEIKNSFGQRIYFAAEDTNFCIRNCCGRSRPFTLRITDNVGREVITLERPLRCNCCCCPCCLQEIEIQAPPGVPVGYVTQTWHPCLTKFTIKNQKREDVLKISGPCIVCSCIAGVDFEITSLDEQIVVGRISKHWSGFLREAFTDADNFGIQFPRDLDVKMKAVMIGACFLIDYMFFERTR

SEQ ID NO: 63490 - protein, 161 aa, Homo sapiens
  Payload ID: 12667
  Gene Symbol: PLSCR2
  Gene Name: phospholipid scramblase 2
  ENSP ID: ENSP00000418444
MPAPPPPLNCPPGLEYLSQIDMILIHQQIELLEVLFSFESSNMYEIKNSFGQRIYFAAEDTNFCIRNCCGRSRPFTLRITDNVGREVITLERPLRCNCCCCPCCLQEIEIQAPPGVPVGYVTQTWHPCLTKFTIKNQKREDVLKISGPCIVCSCIAGVDFE

SEQ ID NO: 63491 - protein, 38 aa, Homo sapiens
  Payload ID: 12667
  Gene Symbol: PLSCR2
  Gene Name: phospholipid scramblase 2
  ENSP ID: ENSP00000419669
MPAPPPPLNCPPGLEYLSQIDMILIHQQIELLEVIDSG

SEQ ID NO: 63492 - protein, 297 aa, Homo sapiens
  Payload ID: 12667
  Gene Symbol: PLSCR2
  Gene Name: phospholipid scramblase 2
  Uniprot ID: Q9NRY7
  ENSP ID: ENSP00000420132
MRSWNSLFCLNSSRPPGHIVYPKHQAGHTGKQADHLGSQAFYPGRQHDYLVPPAGTAGIPVQNQPGRPEGVPWMPAPPPPLNCPPGLEYLSQIDMILIHQQIELLEVLFSFESSNMYEIKNSFGQRIYFAAEDTNFCIRNCCGRSRPFTLRITDNVGREVITLERPLRCNCCCCPCCLQEIEIQAPPGVPVGYVTQTWHPCLTKFTIKNQKREDVLKISGPCIVCSCIAGVDFEITSLDEQIVVGRISKHWSGFLREAFTDADNFGIQFPRDLDVKMKAVMIGACFLIDYMFFERTR

SEQ ID NO: 63493 - protein, 224 aa, Homo sapiens; identical to SEQ ID NO: 63489
  Payload ID: 12667
  Gene Symbol: PLSCR2
  Gene Name: phospholipid scramblase 2
  Uniprot ID: Q9NRY7
  ENSP ID: ENSP00000478044

SEQ ID NO: 63494 - protein, 293 aa, Homo sapiens
  Payload ID: 12667
  Gene Symbol: PLSCR2
  Gene Name: phospholipid scramblase 2
  Uniprot ID: Q9NRY7
  ENSP ID: ENSP00000478902
MKPFQIHLPGPPGHIVYPKHQAGHTGKQADHLGSQAFYPGRQHDYLVPPAGTAGIPVQNQPGRPEGVPWMPAPPPPLNCPPGLEYLSQIDMILIHQQIELLEVLFSFESSNMYEIKNSFGQRIYFAAEDTNFCIRNCCGRSRPFTLRITDNVGREVITLERPLRCNCCCCPCCLQEIEIQAPPGVPVGYVTQTWHPCLTKFTIKNQKREDVLKISGPCIVCSCIAGVDFEITSLDEQIVVGRISKHWSGFLREAFTDADNFGIQFPRDLDVKMKAVMIGACFLIDYMFFERTR

SEQ ID NO: 63495 - protein, 329 aa, Homo sapiens
  Payload ID: 12668
  Gene Symbol: PLSCR4
  Gene Name: phospholipid scramblase 4
  Uniprot ID: Q9NRQ2
  ENSP ID: ENSP00000347038
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYIVTEDTDDFTRNAYRTLRPFVLRVTDCMGREIMTMQRPFRCTCCCFCCPSARQELEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 63496 - protein, 239 aa, Homo sapiens
  Payload ID: 12668
  Gene Symbol: PLSCR4
  Gene Name: phospholipid scramblase 4
  ENSP ID: ENSP00000372561
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 63497 - protein, 329 aa, Homo sapiens; identical to SEQ ID NO: 63495
  Payload ID: 12668
  Gene Symbol: PLSCR4
  Gene Name: phospholipid scramblase 4
  Uniprot ID: Q9NRQ2
  ENSP ID: ENSP00000399315

SEQ ID NO: 63498 - protein, 224 aa, Homo sapiens
  Payload ID: 12668
  Gene Symbol: PLSCR4
  Gene Name: phospholipid scramblase 4
  Uniprot ID: Q9NRQ2
  ENSP ID: ENSP00000415605
MENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 63499 - protein, 97 aa, Homo sapiens
  Payload ID: 12668
  Gene Symbol: PLSCR4
  Gene Name: phospholipid scramblase 4
  ENSP ID: ENSP00000417248
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPI

SEQ ID NO: 63500 - protein, 262 aa, Homo sapiens
  Payload ID: 12668
  Gene Symbol: PLSCR4
  Gene Name: phospholipid scramblase 4
  ENSP ID: ENSP00000417896
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYIVTEDTDDFTRNAYRTLRPFVLRVTDCMGREIMTMQRPFRCTCCCFCCPSARQELEVQCPPGVTIGFVAEHWNLCRAVYSIQNEKKENVMRVRGPCSTYGCGSDSVFE

SEQ ID NO: 63501 - protein, 208 aa, Homo sapiens
  Payload ID: 12668
  Gene Symbol: PLSCR4
  Gene Name: phospholipid scramblase 4
  ENSP ID: ENSP00000418173
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYIVTEDTDDFTRNAYRTLRPFVLRVTDCMGREIMTMQRPFRCTCCCFCCPSARQE

SEQ ID NO: 63502 - protein, 142 aa, Homo sapiens
  Payload ID: 12668
  Gene Symbol: PLSCR4
  Gene Name: phospholipid scramblase 4
  ENSP ID: ENSP00000418419
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNR

SEQ ID NO: 63503 - protein, 329 aa, Homo sapiens; identical to SEQ ID NO: 63495
  Payload ID: 12668
  Gene Symbol: PLSCR4
  Gene Name: phospholipid scramblase 4
  Uniprot ID: Q9NRQ2
  ENSP ID: ENSP00000419040

SEQ ID NO: 63504 - protein, 147 aa, Homo sapiens
  Payload ID: 12668
  Gene Symbol: PLSCR4
  Gene Name: phospholipid scramblase 4
  ENSP ID: ENSP00000420385
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLEVQCPPGVTIGFVAEHWNLCRAVYSIQN

SEQ ID NO: 63505 - protein, 271 aa, Homo sapiens
  Payload ID: 12669
  Gene Symbol: PLSCR5
  Gene Name: phospholipid scramblase family, member 5
  Uniprot ID: A0PG75
  ENSP ID: ENSP00000390111
MASKDAQNQRRGLPGFLPGAPDPDQSLPASSNPGNQAWQLSLPLPSSFLPTVSLPPGLEYLSQLDLIIIHQQVELLGMILGTETSNKYEIKNSLGQRIYFAVEESICFNRTFCSTLRSCTLRITDNSGREVITVNRPLRCNSCWCPCYLQELEIQAPPGTIVGYVTQKWDPFLPKFTIQNANKEDILKIVGPCVTCGCFGDVDFEVKTINEKLTIGKISKYWSGFVNDVFTNADNFGIHVPADLDVTVKAAMIGACFLFDFMFFEHSLAGL

SEQ ID NO: 63506 - protein, 271 aa, Homo sapiens; identical to SEQ ID NO: 63505
  Payload ID: 12669
  Gene Symbol: PLSCR5
  Gene Name: phospholipid scramblase family, member 5
  Uniprot ID: A0PG75
  ENSP ID: ENSP00000417184

SEQ ID NO: 63507 - protein, 259 aa, Homo sapiens
  Payload ID: 12669
  Gene Symbol: PLSCR5
  Gene Name: phospholipid scramblase family, member 5
  Uniprot ID: A0PG75
  ENSP ID: ENSP00000418626
MASKDAQNQRRGLPGFLPGAPDPDQSLPASSNPGNQAWQLSLPLPSSFLPTLDLIIIHQQVELLGMILGTETSNKYEIKNSLGQRIYFAVEESICFNRTFCSTLRSCTLRITDNSGREVITVNRPLRCNSCWCPCYLQELEIQAPPGTIVGYVTQKWDPFLPKFTIQNANKEDILKIVGPCVTCGCFGDVDFEVKTINEKLTIGKISKYWSGFVNDVFTNADNFGIHVPADLDVTVKAAMIGACFLFDFMFFEHSLAGL

SEQ ID NO: 63508 - protein, 441 aa, Homo sapiens
  Payload ID: 12670
  Gene Symbol: PLTP
  Gene Name: phospholipid transfer protein
  Uniprot ID: P55058
  ENSP ID: ENSP00000335290
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFLKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 63509 - protein, 405 aa, Homo sapiens
  Payload ID: 12670
  Gene Symbol: PLTP
  Gene Name: phospholipid transfer protein
  Uniprot ID: P55058
  ENSP ID: ENSP00000361497
MLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 63510 - protein, 493 aa, Homo sapiens
  Payload ID: 12670
  Gene Symbol: PLTP
  Gene Name: phospholipid transfer protein
  Uniprot ID: P55058
  ENSP ID: ENSP00000361508
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 63511 - protein, 398 aa, Homo sapiens
  Payload ID: 12670
  Gene Symbol: PLTP
  Gene Name: phospholipid transfer protein
  Uniprot ID: P55058
  ENSP ID: ENSP00000411671
MALFGALFLALLAGAHAEFPGCKIRVTSKALELVKQEGLRFLEQELETITIPDLRGKEGHFYYNISEKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 63512 - protein, 493 aa, Homo sapiens; identical to SEQ ID NO: 63510
  Payload ID: 12670
  Gene Symbol: PLTP
  Gene Name: phospholipid transfer protein
  Uniprot ID: P55058
  ENSP ID: ENSP00000417138

SEQ ID NO: 63513 - protein, 210 aa, Homo sapiens
  Payload ID: 12671
  Gene Symbol: LHPP
  Gene Name: phospholysine phosphohistidine inorganic pyrophosphate phosphatase
  Uniprot ID: Q9H008
  ENSP ID: ENSP00000357832
MAPWGKRLAGVRGVLLDISGVLYDSGAGGGTAIAGSVEAVARLKRSRLKVRFCTNESQKSRAELVGQLQRLGFDISEQEVTAPAPAACQILKEQGLRPYLLIHDGVRSEFDQIDTSNPNCVVIADAGESFSYQNMNNAFQVLMELEKPVLISLGKGRYYKETSGLMLDVGPYMKALEYACGIKAEVVGKPSPEFFKSALQAIGVEAHQAQ

SEQ ID NO: 63514 - protein, 270 aa, Homo sapiens
  Payload ID: 12671
  Gene Symbol: LHPP
  Gene Name: phospholysine phosphohistidine inorganic pyrophosphate phosphatase
  Uniprot ID: Q9H008
  ENSP ID: ENSP00000357835
MAPWGKRLAGVRGVLLDISGVLYDSGAGGGTAIAGSVEAVARLKRSRLKVRFCTNESQKSRAELVGQLQRLGFDISEQEVTAPAPAACQILKEQGLRPYLLIHDGVRSEFDQIDTSNPNCVVIADAGESFSYQNMNNAFQVLMELEKPVLISLGKGRYYKETSGLMLDVGPYMKALEYACGIKAEVVGKPSPEFFKSALQAIGVEAHQAVMIGDDIVGDVGGAQRCGMRALQVRTGKFRPSDEHHPEVKADGYVDNLAEAVDLLLQHADK

SEQ ID NO: 63515 - protein, 212 aa, Homo sapiens
  Payload ID: 12671
  Gene Symbol: LHPP
  Gene Name: phospholysine phosphohistidine inorganic pyrophosphate phosphatase
  ENSP ID: ENSP00000376512
MAPWGKRLAGVRGVLLDISGVLYDSGAGGGTAIAGSVEAVARLKRSRLKVRFCTNESQKSRAELVGQLQRLGFDISEQEVTAPAPAACQILKEQGLRPYLLIHDGVRSEFDQIDTSNPNCVVIADAGESFSYQNMNNAFQVLMELEKPVLISLGKGRYYKETSGLMLDVGPYMKALEYACGIKAEVVGKPSPEFFKSALQAIGVEAHQLLSV

SEQ ID NO: 63516 - protein, 262 aa, Homo sapiens
  Payload ID: 12672
  Gene Symbol: PMM1
  Gene Name: phosphomannomutase 1
  Uniprot ID: Q92871
  ENSP ID: ENSP00000216259
MAVTAQAARRKERVLCLFDVDGTLTPARQKIDPEVAAFLQKLRSRVQIGVVGGSDYCKIAEQLGDGDEVIEKFDYVFAENGTVQYKHGRLLSKQTIQNHLGEELLQDLINFCLSYMALLRLPKKRGTFIEFRNGMLNISPIGRSCTLEERIEFSELDKKEKIREKFVEALKTEFAGKGLRFSRGGMISFDVFPEGWDKRYCLDSLDQDSFDTIHFFGNETSPGGNDFEIFADPRTVGHSVVSPQDTVQRCREIFFPETAHEA

SEQ ID NO: 63517 - protein, 68 aa, Homo sapiens
  Payload ID: 12672
  Gene Symbol: PMM1
  Gene Name: phosphomannomutase 1
  ENSP ID: ENSP00000400889
MAVTAQAARRKERVLCLFDVDGTLTPARQSWSREGFFSNSFMSSTHPDVRGSRPSLFAVRTLRNSEEN

SEQ ID NO: 63518 - protein, 246 aa, Homo sapiens
  Payload ID: 12673
  Gene Symbol: PMM2
  Gene Name: phosphomannomutase 2
  Uniprot ID: O15305
  ENSP ID: ENSP00000268261
MAAPGPALCLFDVDGTLTAPRQKITKEMDDFLQKLRQKIKIGVVGGSDFEKVQEQLGNDVVEKYDYVFPENGLVAYKDGKLLCRQNIQSHLGEALIQDLINYCLSYIAKIKLPKKRGTFIEFRNGMLNVSPIGRSCSQEERIEFYELDKKENIRQKFVADLRKEFAGKGLTFSIGGQISFDVFPDGWDKRYCLRHVENDGYKTIYFFGDKTMPGGNDHEIFTDPRTMGYSVTAPEDTRRICELLFS

SEQ ID NO: 63519 - protein, 66 aa, Homo sapiens
  Payload ID: 12673
  Gene Symbol: PMM2
  Gene Name: phosphomannomutase 2
  ENSP ID: ENSP00000454284
MAAPGPALCLFDVDGTLTAPRQKITKEMDDFLQKLRQKIKIGVVGGSDFEKVQEQLGNDEYSKSSG

SEQ ID NO: 63520 - protein, 66 aa, Homo sapiens; identical to SEQ ID NO: 63519
  Payload ID: 12673
  Gene Symbol: PMM2
  Gene Name: phosphomannomutase 2
  ENSP ID: ENSP00000454395

SEQ ID NO: 63521 - protein, 91 aa, Homo sapiens
  Payload ID: 12673
  Gene Symbol: PMM2
  Gene Name: phosphomannomutase 2
  ENSP ID: ENSP00000455066
MAAPGPALCLFDVDGTLTAPRQKITKEMDDFLQKLRQKIKIGVVGGSDFEKVQEQLGNDAPLTSPSLKQNLQHRTPKNQRGLLTPSLESLT

SEQ ID NO: 63522 - protein, 142 aa, Homo sapiens
  Payload ID: 12673
  Gene Symbol: PMM2
  Gene Name: phosphomannomutase 2
  ENSP ID: ENSP00000455320
  MOD_RES (1)..(1): Any amino acid
XFDVDGTLTAPRQKITKEMDDFLQKLRQKIKIGVVGGSDFEKVQEQLGNDVVEKYDYVFPENGLVAYKDGKLLCRQNIQSHLGEALIQDLINYCLSYIAKIKLPKKRGTFIEFRNGMLNVSPIGRSCSQEERIEFYELDKKI

SEQ ID NO: 63523 - protein, 65 aa, Homo sapiens
  Payload ID: 12673
  Gene Symbol: PMM2
  Gene Name: phosphomannomutase 2
  ENSP ID: ENSP00000456024
MAAPGPALCLFDVDGTLTAPRQKITKEMDDFLQKLRQKIKIGVVGGSDFEKVQEQLGNDVHFWSY

SEQ ID NO: 63524 - protein, 66 aa, Homo sapiens; identical to SEQ ID NO: 63519
  Payload ID: 12673
  Gene Symbol: PMM2
  Gene Name: phosphomannomutase 2
  ENSP ID: ENSP00000456275

SEQ ID NO: 63525 - protein, 155 aa, Homo sapiens
  Payload ID: 12673
  Gene Symbol: PMM2
  Gene Name: phosphomannomutase 2
  ENSP ID: ENSP00000456302
MAAPGPALCLFDVDGTLTAPRQKITKEMDDFLQKLRQKIKIGVVGGSDFEKVQEQLGNDENIRQKFVADLRKEFAGKGLTFSIGGQISFDVFPDGWDKRYCLRHVENDGYKTIYFFGDKTMPGGNDHEIFTDPRTMGYSVTAPEDTRRICELLFS

SEQ ID NO: 63526 - protein, 119 aa, Homo sapiens
  Payload ID: 12673
  Gene Symbol: PMM2
  Gene Name: phosphomannomutase 2
  Uniprot ID: O15305
  ENSP ID: ENSP00000456774
MAAPGPALCLFDVDGTLTAPRQKITKEMDDFLQKLRQKIKIGVVGGSDFEKVQEQLGNDVVEKYDYVFPENGLVAYKDGKLLCRQNIQSHLGEALIQDLINYCLSYIAKIKLPKKRKKI

SEQ ID NO: 63527 - protein, 90 aa, Homo sapiens
  Payload ID: 12673
  Gene Symbol: PMM2
  Gene Name: phosphomannomutase 2
  ENSP ID: ENSP00000456961
MAAPGPALCLFDVDGTLTAPRQKITKEMDDFLQKLRQKIKIGVVGGSDFEKVQEQLGNDERKYKTKVCSRSTERVCWKRPHVFHRRPDQL

SEQ ID NO: 63528 - protein, 70 aa, Homo sapiens
  Payload ID: 12673
  Gene Symbol: PMM2
  Gene Name: phosphomannomutase 2
  ENSP ID: ENSP00000457932
MAAPGPALCLFDVDGTLTAPRQKITKEMDDFLQKLRQKIKIGVVGGSDFEKVQEQLGNDGVLSLNSEMGC

SEQ ID NO: 63529 - protein, 219 aa, Homo sapiens
  Payload ID: 12673
  Gene Symbol: PMM2
  Gene Name: phosphomannomutase 2
  ENSP ID: ENSP00000457956
MDDFLQKLRQKIKIGVVGGSDFEKVQEQLGNDVVEKYDYVFPENGLVAYKDGKLLCRQNIQSHLGEALIQDLINYCLSYIAKIKLPKKRGTFIEFRNGMLNVSPIGRSCSQEERIEFYELDKKENIRQKFVADLRKEFAGKGLTFSIGGQISFDVFPDGWDKRYCLRHVENDGYKTIYFFGDKTMPGGNDHEIFTDPRTMGYSVTAPEDTRRICELLFS

SEQ ID NO: 63530 - protein, 192 aa, Homo sapiens
  Payload ID: 12674
  Gene Symbol: PMVK
  Gene Name: phosphomevalonate kinase
  Uniprot ID: Q15126
  ENSP ID: ENSP00000357452
MAPLGGAPRLVLLFSGKRKSGKDFVTEALQSRLGADVCAVLRLSGPLKEQYAQEHGLNFQRLLDTSTYKEAFRKDMIRWGEEKRQADPGFFCRKIVEGISQPIWLVSDTRRVSDIQWFREAYGAVTQTVRVVALEQSRQQRGWVFTPGVDDAESECGLDNFGDFDWVIENHGVEQRLEEQLENLIEFIRSRL

SEQ ID NO: 63531 - protein, 204 aa, Homo sapiens
  Payload ID: 12675
  Gene Symbol: PPCDC
  Gene Name: phosphopantothenoylcysteine decarboxylase
  Uniprot ID: Q96CD2
  ENSP ID: ENSP00000343190
MEPKASCPAAAPLMERKFHVLVGVTGSVAALKLPLLVSKLLDIPGLEVAVVTTERAKHFYSPQDIPVTLYSDADEWEIWKSRSDPVLHIDLRRWADLLLVAPLDANTLGKVASGICDNLLTCVMRAWDRSKPLLFCPAMNTAMWEHPITAQQVDQLKAFGYVEIPCVAKKLVCGDEGLGAMAEVGTIVDKVKEVLFQHSGFQQS

SEQ ID NO: 63532 - protein, 64 aa, Homo sapiens
  Payload ID: 12675
  Gene Symbol: PPCDC
  Gene Name: phosphopantothenoylcysteine decarboxylase
  ENSP ID: ENSP00000455499
MRAWDRSKPLLFCPAMNTAMWEHPITAQQVDQLKAFGYVEIPCVAKKLVCGDEGLGAMAEVGTI

SEQ ID NO: 63533 - protein, 161 aa, Homo sapiens
  Payload ID: 12675
  Gene Symbol: PPCDC
  Gene Name: phosphopantothenoylcysteine decarboxylase
  ENSP ID: ENSP00000455691
MEPKASCPAAAPLMERKFHVLVGVTGSVAALKLPLLVSKLLDIPGLEVAVVTTERAKHFYSPQDIPVTLYSDADEWETCVMRAWDRSKPLLFCPAMNTAMWEHPITAQQVDQLKAFGYVEIPCVAKKLVCGDEGLGAMAEVGTIVDKVKEVLFQHSGFQQS

SEQ ID NO: 63534 - protein, 172 aa, Homo sapiens
  Payload ID: 12675
  Gene Symbol: PPCDC
  Gene Name: phosphopantothenoylcysteine decarboxylase
  ENSP ID: ENSP00000456353
MEPKASCPAAAPLMERKFHVLVGVTGSVAALKLPLLVSKLLDIPGIWKSRSDPVLHIDLRRWADLLLVAPLDANTLGKVASGICDNLLTCVMRAWDRSKPLLFCPAMNTAMWEHPITAQQVDQLKAFGYVEIPCVAKKLVCGDEGLGAMAEVGTIVDKVKEVLFQHSGFQQS

SEQ ID NO: 63535 - protein, 129 aa, Homo sapiens
  Payload ID: 12675
  Gene Symbol: PPCDC
  Gene Name: phosphopantothenoylcysteine decarboxylase
  ENSP ID: ENSP00000456665
MEPKASCPAAAPLMERKFHVLVGVTGSVAALKLPLLVSKLLDIPGTCVMRAWDRSKPLLFCPAMNTAMWEHPITAQQVDQLKAFGYVEIPCVAKKLVCGDEGLGAMAEVGTIVDKVKEVLFQHSGFQQS

SEQ ID NO: 63536 - protein, 62 aa, Homo sapiens
  Payload ID: 12675
  Gene Symbol: PPCDC
  Gene Name: phosphopantothenoylcysteine decarboxylase
  ENSP ID: ENSP00000457446
MEPKASCPAAAPLMERKFHVLVGVTGSVAALKLPLLVSKLLDIPGLEVAVVTTERAKHFYSP

SEQ ID NO: 63537 - protein, 81 aa, Homo sapiens
  Payload ID: 12675
  Gene Symbol: PPCDC
  Gene Name: phosphopantothenoylcysteine decarboxylase
  ENSP ID: ENSP00000457490
MRAWDRSKPLLFCPAMNTAMWEHPITAQQVDQLKAFGYVEIPCVAKKLVCGDEGLGAMAEVGTIVDKVKEVLFQHSGFQQS

SEQ ID NO: 63538 - protein, 56 aa, Homo sapiens
  Payload ID: 12676
  Gene Symbol: PPCS
  Gene Name: phosphopantothenoylcysteine synthetase
  ENSP ID: ENSP00000361637
MAEMDPVAEFPQPPGAARWAEALLRCFTWLRLCQISMFLSLKCLNTRSSHLGAHCR

SEQ ID NO: 63539 - protein, 213 aa, Homo sapiens
  Payload ID: 12676
  Gene Symbol: PPCS
  Gene Name: phosphopantothenoylcysteine synthetase
  ENSP ID: ENSP00000361641
MAEMDPVAEFPQPPGAARWAEVMARFAARLGAQGRRVVLVTSGGTKVPLEARPVRFLDNFSSGRRGATSAEAFLAAGYGVLFLYRARSAFPYAHRFPPQTWLSALRPSGPALSGLLSLEAEENALPGFAEALRSYQEAAAAGTFLAVEFTTLADYLHLLQAAAQALNPLGPSAMFYLAAAVSDFYVPVSEMPEHKIQSSGGPLQVMGASLPEI

SEQ ID NO: 63540 - protein, 311 aa, Homo sapiens
  Payload ID: 12676
  Gene Symbol: PPCS
  Gene Name: phosphopantothenoylcysteine synthetase
  Uniprot ID: Q9HAB8
  ENSP ID: ENSP00000361642
MAEMDPVAEFPQPPGAARWAEVMARFAARLGAQGRRVVLVTSGGTKVPLEARPVRFLDNFSSGRRGATSAEAFLAAGYGVLFLYRARSAFPYAHRFPPQTWLSALRPSGPALSGLLSLEAEENALPGFAEALRSYQEAAAAGTFLAVEFTTLADYLHLLQAAAQALNPLGPSAMFYLAAAVSDFYVPVSEMPEHKIQSSGGPLQITMKMVPKLLSPLVKDWAPKAFIISFKLETDPAIVINRARKALEIYQHQVVVANILESRQSFVFIVTKDSETKLLLSEEEIEKGVEIEEKIVDNLQSRHTAFIGDRN

SEQ ID NO: 63541 - protein, 138 aa, Homo sapiens
  Payload ID: 12676
  Gene Symbol: PPCS
  Gene Name: phosphopantothenoylcysteine synthetase
  Uniprot ID: Q9HAB8
  ENSP ID: ENSP00000361643
MFYLAAAVSDFYVPVSEMPEHKIQSSGGPLQITMKMVPKLLSPLVKDWAPKAFIISFKLETDPAIVINRARKALEIYQHQVVVANILESRQSFVFIVTKDSETKLLLSEEEIEKGVEIEEKIVDNLQSRHTAFIGDRN

SEQ ID NO: 63542 - protein, 130 aa, Homo sapiens
  Payload ID: 12677
  Gene Symbol: PEA15
  Gene Name: phosphoprotein enriched in astrocytes 15
  Uniprot ID: Q15121
  ENSP ID: ENSP00000353660
MAEYGTLLQDLTNNITLEDLEQLKSACKEDIPSEKSEEITTGSAWFSFLESHNKLDKDNLSYIEHIFEISRRPDLLTMVVDYRTRVLKISEEDELDTKLTRIPSAKKYKDIIRQPSEEEIIKLAPPPKKA

SEQ ID NO: 63543 - protein, 151 aa, Homo sapiens
  Payload ID: 12677
  Gene Symbol: PEA15
  Gene Name: phosphoprotein enriched in astrocytes 15
  Uniprot ID: Q15121
  ENSP ID: ENSP00000357055
MEDEGNKLCQAPPWPGQTSPVMAEYGTLLQDLTNNITLEDLEQLKSACKEDIPSEKSEEITTGSAWFSFLESHNKLDKDNLSYIEHIFEISRRPDLLTMVVDYRTRVLKISEEDELDTKLTRIPSAKKYKDIIRQPSEEEIIKLAPPPKKA

SEQ ID NO: 63544 - protein, 108 aa, Homo sapiens
  Payload ID: 12677
  Gene Symbol: PEA15
  Gene Name: phosphoprotein enriched in astrocytes 15
  ENSP ID: ENSP00000357056
MAEYGTLLQDLTNNITLEDLEQLKSACKEDIPSEKNNLSYIEHIFEISRRPDLLTMVVDYRTRVLKISEEDELDTKLTRIPSAKKYKDIIRQPSEEEIIKLAPPPKKA

SEQ ID NO: 63545 - protein, 432 aa, Homo sapiens
  Payload ID: 12678
  Gene Symbol: PAG1
  Gene Name: phosphoprotein membrane anchor with glycosphingolipid microdomains 1
  Uniprot ID: Q9NWQ8
  ENSP ID: ENSP00000220597
MGPAGSLLGSGQMQITLWGSLAAVAIFFVITFLIFLCSSCDREKKPRQHSGDHENLMNVPSDKEMFSRSVTSLATDAPASSEQNGALTNGDILSEDSTLTCMQHYEEVQTSASDLLDSQDSTGKPKCHQSRELPRIPPESAVDTMLTARSVDGDQGLGMEGPYEVLKDSSSQENMVEDCLYETVKEIKEVAAAAHLEKGHSGKAKSTSASKELPGPQTEGKAEFAEYASVDRNKKCRQSVNVESILGNSCDPEEEAPPPVPVKLLDENENLQEKEGGEAEESATDTTSETNKRFSSLSYKSREEDPTLTEEEISAMYSSVNKPGQLVNKSGQSLTVPESTYTSIQGDPQRSPSSCNDLYATVKDFEKTPNSTLPPAGRPSEEPEPDYEAIQTLNREEEKATLGTNGHHGLVPKENDYESISDLQQGRDITRL

SEQ ID NO: 63546 - protein, 517 aa, Homo sapiens
  Payload ID: 12679
  Gene Symbol: PPAT
  Gene Name: phosphoribosyl pyrophosphate amidotransferase
  Uniprot ID: Q06203
  ENSP ID: ENSP00000264220
MELEELGIREECGVFGCIASGEWPTQLDVPHVITLGLVGLQHRGQESAGIVTSDGSSVPTFKSHKGMGLVNHVFTEDNLKKLYVSNLGIGHTRYATTGKCELENCQPFVVETLHGKIAVAHNGELVNAARLRKKLLRHGIGLSTSSDSEMITQLLAYTPPQEQDDTPDWVARIKNLMKEAPTAYSLLIMHRDVIYAVRDPYGNRPLCIGRLIPVSDINDKEKKTSETEGWVVSSESCSFLSIGARYYREVLPGEIVEISRHNVQTLDIISRSEGNPVAFCIFEYVYFARPDSMFEDQMVYTVRYRCGQQLAIEAPVDADLVSTVPESATPAALAYAGKCGLPYVEVLCKNRYVGRTFIQPNMRLRQLGVAKKFGVLSDNFKGKRIVLVDDSIVRGNTISPIIKLLKESGAKEVHIRVASPPIKYPCFMGINIPTKEELIANKPEFDHLAEYLGANSVVYLSVEGLVSSVQEGIKFKKQKEKKHDIMIQENGNGLECFEKSGHCTACLTGKYPVELEW

SEQ ID NO: 63547 - protein, 192 aa, Homo sapiens
  Payload ID: 12679
  Gene Symbol: PPAT
  Gene Name: phosphoribosyl pyrophosphate amidotransferase
  ENSP ID: ENSP00000423781
MELEELGIREECGVFGCIASGEWPTQLDVPHVITLGLVGLQHRGQESAGIVTSDGSSVPTFKSHKGMGLVNHVFTEDNLKKLYVSNLGIGHTRYATTGKCELENCQPFVVETLHGKIAVAHNGELVNAARLRKKISYCLQPWSSVISIYILLAQESPTPVLGTSTSLWLVRNQATQQEVSASASWYWSVYKF

SEQ ID NO: 63548 - protein, 72 aa, Homo sapiens
  Payload ID: 12679
  Gene Symbol: PPAT
  Gene Name: phosphoribosyl pyrophosphate amidotransferase
  ENSP ID: ENSP00000425119
MELEELGIREECGVFGCIASGEWPTQLDVPHVITLGLVGLQHRGQESAGIVTSDGSSVPTFKSHKVCHHRKM

SEQ ID NO: 63549 - protein, 218 aa, Homo sapiens
  Payload ID: 12680
  Gene Symbol: PRPS1
  Gene Name: phosphoribosyl pyrophosphate synthetase 1
  ENSP ID: ENSP00000361495
MELLIMINACKIASASRVTAVIPCFPYARQDKKDKGFFDIPVDNLYAEPAVLKWIRENISEWRNCTIVSPDAGGAKRVTSIADRLNVDFALIHKERKKANEVDRMVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 63550 - protein, 168 aa, Homo sapiens
  Payload ID: 12680
  Gene Symbol: PRPS1
  Gene Name: phosphoribosyl pyrophosphate synthetase 1
  ENSP ID: ENSP00000361496
MPNIKIFSGSSHQDLSQKIADRLGLELGKVVTKKFSNQETCVEIGESVRGEDVYIVQSGCGEINDNLMELLIMINACKIASASRVTAVIPCFPYARQDKKDKSRAPISAKLVANMLSVAGADHIITMDLHASQIQVSVEAKYWCLKGGRKGLMMLKTAEKPKIMPKYI

SEQ ID NO: 63551 - protein, 114 aa, Homo sapiens
  Payload ID: 12680
  Gene Symbol: PRPS1
  Gene Name: phosphoribosyl pyrophosphate synthetase 1
  ENSP ID: ENSP00000361505
MVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 63552 - protein, 318 aa, Homo sapiens
  Payload ID: 12680
  Gene Symbol: PRPS1
  Gene Name: phosphoribosyl pyrophosphate synthetase 1
  Uniprot ID: P60891
  ENSP ID: ENSP00000361512
MPNIKIFSGSSHQDLSQKIADRLGLELGKVVTKKFSNQETCVEIGESVRGEDVYIVQSGCGEINDNLMELLIMINACKIASASRVTAVIPCFPYARQDKKDKSRAPISAKLVANMLSVAGADHIITMDLHASQIQGFFDIPVDNLYAEPAVLKWIRENISEWRNCTIVSPDAGGAKRVTSIADRLNVDFALIHKERKKANEVDRMVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 63553 - protein, 318 aa, Homo sapiens
  Payload ID: 12681
  Gene Symbol: PRPS1L1
  Gene Name: phosphoribosyl pyrophosphate synthetase 1-like 1
  ENSP ID: ENSP00000424595
TPNIKIFSGSSHQDLSQKIADRLGLELGKVVTKKFSNQETCVEIDESVRGEDVYIVQSGCGEINDSLMELLIMINACKIASASRVTAVIPCFPYARQDKKDKSRSPISAKLVANMLSIAGADHIITMDLHASQIQGFFDIPVDNLYAEPTVLKWIRENIPEWKNCIIVSPDAGGAKRVTSIADQLNVDFALIHKERKKANEVDCIVLVGDVNDRVAILVDDMADTCVTICLAADKLLSAGATRVYAILTHGIFSGPAISRINTACFEAVVVTNTIPQDEKMKHCSKIRVIDISMILAEAIRRTHNGESVSYLFSHVPL

SEQ ID NO: 63554 - protein, 147 aa, Homo sapiens
  Payload ID: 12682
  Gene Symbol: PRPS2
  Gene Name: phosphoribosyl pyrophosphate synthetase 2
  ENSP ID: ENSP00000370038
MPNIVLFSGSSHQDLSQRVADRLGLELGKVVTKKFSNQETSVEIGESVRGEDVYIIQSGCGEINDNLMELLIMINACKIASSSRVTAVIPCFPYARQDKKDKSRAPISAKLVANMLSVAGADHIITMDLHASQIQGKHCRVEELYHC

SEQ ID NO: 63555 - protein, 318 aa, Homo sapiens
  Payload ID: 12682
  Gene Symbol: PRPS2
  Gene Name: phosphoribosyl pyrophosphate synthetase 2
  Uniprot ID: P11908
  ENSP ID: ENSP00000370043
MPNIVLFSGSSHQDLSQRVADRLGLELGKVVTKKFSNQETSVEIGESVRGEDVYIIQSGCGEINDNLMELLIMINACKIASSSRVTAVIPCFPYARQDKKDKSRAPISAKLVANMLSVAGADHIITMDLHASQIQGFFDIPVDNLYAEPAVLQWIRENIAEWKNCIIVSPDAGGAKRVTSIADRLNVEFALIHKERKKANEVDRMVLVGDVKDRVAILVDDMADTCGTICHAADKLLSAGATKVYAILTHGIFSGPAISRINNAAFEAVVVTNTIPQEDKMKHCTKIQVIDISMILAEAIRRTHNGESVSYLFSHVPL

SEQ ID NO: 63556 - protein, 321 aa, Homo sapiens
  Payload ID: 12682
  Gene Symbol: PRPS2
  Gene Name: phosphoribosyl pyrophosphate synthetase 2
  Uniprot ID: P11908
  ENSP ID: ENSP00000381504
MPNIVLFSGSSHQDLSQRVADRLGLELGKVVTKKFSNQETSVEIGESVRGEDVYIIQSGCGEINDNLMELLIMINACKIASSSRVTAVIPCFPYARQDKKDKVGESRAPISAKLVANMLSVAGADHIITMDLHASQIQGFFDIPVDNLYAEPAVLQWIRENIAEWKNCIIVSPDAGGAKRVTSIADRLNVEFALIHKERKKANEVDRMVLVGDVKDRVAILVDDMADTCGTICHAADKLLSAGATKVYAILTHGIFSGPAISRINNAAFEAVVVTNTIPQEDKMKHCTKIQVIDISMILAEAIRRTHNGESVSYLFSHVPL

SEQ ID NO: 63557 - protein, 173 aa, Homo sapiens
  Payload ID: 12682
  Gene Symbol: PRPS2
  Gene Name: phosphoribosyl pyrophosphate synthetase 2
  ENSP ID: ENSP00000418911
CFPYARQDKKDKVGESRAPISAKLVANMLSVAGADHIITMDLHASQIQGFFDIPVDNLYAEPAVLQWIRENIAEWKNCIIVSPDAGGAKRLLSAGATKVYAILTHGIFSGPAISRINNAAFEAVVVTNTIPQEDKMKHCTKIQVIDISMILAEAIRRTHNGESVSYLFSHVPL

SEQ ID NO: 63558 - protein, 200 aa, Homo sapiens
  Payload ID: 12682
  Gene Symbol: PRPS2
  Gene Name: phosphoribosyl pyrophosphate synthetase 2
  ENSP ID: ENSP00000419380
MPNIVLFSGSSHQDLSQRVADRLGLELGKVVTKKFSNQETSVEIGESVRGEDVYIIQSGCGEINDNLMELLIMINACKIASSSRVTAVIPCFPYARQDKKDKSRAPISAKLVANMLSVAGADHIITMDLHASQIQGFFDIPVDNLYAEPAVLQWIRENIAEWKNCIIVSPDAGGAKRYHAGYTLQISPSADWFFLFRCIR

SEQ ID NO: 63559 - protein, 282 aa, Homo sapiens
  Payload ID: 12683
  Gene Symbol: PRPSAP1
  Gene Name: phosphoribosyl pyrophosphate synthetase-associated protein 1
  ENSP ID: ENSP00000314973
MELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDEVVVTNTVPHEVQKLQCPKIKTVDISLILSEAIRRIHNGESMAYLFRNITVDD

SEQ ID NO: 63560 - protein, 157 aa, Homo sapiens
  Payload ID: 12683
  Gene Symbol: PRPSAP1
  Gene Name: phosphoribosyl pyrophosphate synthetase-associated protein 1
  ENSP ID: ENSP00000387494
MELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELP

SEQ ID NO: 63561 - protein, 230 aa, Homo sapiens
  Payload ID: 12683
  Gene Symbol: PRPSAP1
  Gene Name: phosphoribosyl pyrophosphate synthetase-associated protein 1
  ENSP ID: ENSP00000392838
MELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDE

SEQ ID NO: 63562 - protein, 104 aa, Homo sapiens
  Payload ID: 12683
  Gene Symbol: PRPSAP1
  Gene Name: phosphoribosyl pyrophosphate synthetase-associated protein 1
  ENSP ID: ENSP00000402126
MGLGAPVGIGKPSMWRLGAELGKSVVYQETNGETRVEIKESVRGQDIFIIQTIPRDVNTAVMELLIMAYALKTACARNIIGVIPYFPYSKQSKMRKRGSIVCKL

SEQ ID NO: 63563 - protein, 89 aa, Homo sapiens
  Payload ID: 12683
  Gene Symbol: PRPSAP1
  Gene Name: phosphoribosyl pyrophosphate synthetase-associated protein 1
  ENSP ID: ENSP00000409190
MELLIMAYALKTACARNIIGVIPYFPYSKQSKMRKRGSIVCKLLASMLAKAGLTHIITMDLHQKEIQGFFSFPVDNLRASPFLLQYIQE

SEQ ID NO: 63564 - protein, 385 aa, Homo sapiens
  Payload ID: 12683
  Gene Symbol: PRPSAP1
  Gene Name: phosphoribosyl pyrophosphate synthetase-associated protein 1
  Uniprot ID: Q14558
  ENSP ID: ENSP00000414624
MPKKLLLLPPPSASSAFRVPRARPVPPPAMNAARTGYRVFSANSTAACTELAKRITERLGAELGKSVVYQETNGETRVEIKESVRGQDIFIIQTIPRDVNTAVMELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDEVVVTNTVPHEVQKLQCPKIKTVDISLILSEAIRRIHNGESMAYLFRNITVDD

SEQ ID NO: 63565 - protein, 369 aa, Homo sapiens
  Payload ID: 12684
  Gene Symbol: PRPSAP2
  Gene Name: phosphoribosyl pyrophosphate synthetase-associated protein 2
  Uniprot ID: O60256
  ENSP ID: ENSP00000268835
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 63566 - protein, 78 aa, Homo sapiens
  Payload ID: 12684
  Gene Symbol: PRPSAP2
  Gene Name: phosphoribosyl pyrophosphate synthetase-associated protein 2
  ENSP ID: ENSP00000379017
MFCVTPPELETKMNITKGGLVLFSANSNSSCMELSKKIAENKSTNSRVCEGKRCFHHPNCFEGREHHHHGAPDHGVCM

SEQ ID NO: 63567 - protein, 329 aa, Homo sapiens
  Payload ID: 12684
  Gene Symbol: PRPSAP2
  Gene Name: phosphoribosyl pyrophosphate synthetase-associated protein 2
  Uniprot ID: O60256
  ENSP ID: ENSP00000392536
MFCVTPPELETKMNITKGGLVLFSANSNSSCMELSKKIAEDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 63568 - protein, 140 aa, Homo sapiens
  Payload ID: 12684
  Gene Symbol: PRPSAP2
  Gene Name: phosphoribosyl pyrophosphate synthetase-associated protein 2
  ENSP ID: ENSP00000395127
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLT

SEQ ID NO: 63569 - protein, 268 aa, Homo sapiens
  Payload ID: 12684
  Gene Symbol: PRPSAP2
  Gene Name: phosphoribosyl pyrophosphate synthetase-associated protein 2
  ENSP ID: ENSP00000399625
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIV

SEQ ID NO: 63570 - protein, 244 aa, Homo sapiens
  Payload ID: 12684
  Gene Symbol: PRPSAP2
  Gene Name: phosphoribosyl pyrophosphate synthetase-associated protein 2
  ENSP ID: ENSP00000401144
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIP

SEQ ID NO: 63571 - protein, 268 aa, Homo sapiens; identical to SEQ ID NO: 63569
  Payload ID: 12684
  Gene Symbol: PRPSAP2
  Gene Name: phosphoribosyl pyrophosphate synthetase-associated protein 2
  ENSP ID: ENSP00000402612

SEQ ID NO: 63572 - protein, 176 aa, Homo sapiens
  Payload ID: 12684
  Gene Symbol: PRPSAP2
  Gene Name: phosphoribosyl pyrophosphate synthetase-associated protein 2
  ENSP ID: ENSP00000415446
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEE

SEQ ID NO: 63573 - protein, 161 aa, Homo sapiens
  Payload ID: 12684
  Gene Symbol: PRPSAP2
  Gene Name: phosphoribosyl pyrophosphate synthetase-associated protein 2
  ENSP ID: ENSP00000416021
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKADPRLQECSNRGQVSSLGEEGTVFC

SEQ ID NO: 63574 - protein, 194 aa, Homo sapiens
  Payload ID: 12684
  Gene Symbol: PRPSAP2
  Gene Name: phosphoribosyl pyrophosphate synthetase-associated protein 2
  ENSP ID: ENSP00000416964
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAK

SEQ ID NO: 63575 - protein, 320 aa, Homo sapiens
  Payload ID: 12684
  Gene Symbol: PRPSAP2
  Gene Name: phosphoribosyl pyrophosphate synthetase-associated protein 2
  Uniprot ID: O60256
  ENSP ID: ENSP00000439129
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVVVVTNTIPHEVQKLQCPKIKTVDISMILSEAIRRIHNGESMSYLFRNIGLDD

SEQ ID NO: 63576 - protein, 283 aa, Homo sapiens
  Payload ID: 12684
  Gene Symbol: PRPSAP2
  Gene Name: phosphoribosyl pyrophosphate synthetase-associated protein 2
  Uniprot ID: O60256
  ENSP ID: ENSP00000443967
MELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 63577 - protein, 260 aa, Homo sapiens
  Payload ID: 12684
  Gene Symbol: PRPSAP2
  Gene Name: phosphoribosyl pyrophosphate synthetase-associated protein 2
  ENSP ID: ENSP00000458301
  MOD_RES (1)..(1): Any amino acid
XDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPTWSAVVQSWHTATSASQVQAILLGSWDYRYMPPCPVLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 63578 - protein, 104 aa, Homo sapiens
  Payload ID: 12684
  Gene Symbol: PRPSAP2
  Gene Name: phosphoribosyl pyrophosphate synthetase-associated protein 2
  ENSP ID: ENSP00000458600
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSI

SEQ ID NO: 63579 - protein, 47 aa, Homo sapiens
  Payload ID: 12684
  Gene Symbol: PRPSAP2
  Gene Name: phosphoribosyl pyrophosphate synthetase-associated protein 2
  ENSP ID: ENSP00000459077
MFCVTPPELETKMNITKGGLVLFSANSNSSCMELSKKIADFFPLSLL

SEQ ID NO: 63580 - protein, 22 aa, Homo sapiens
  Payload ID: 12684
  Gene Symbol: PRPSAP2
  Gene Name: phosphoribosyl pyrophosphate synthetase-associated protein 2
  ENSP ID: ENSP00000459441
MFCVTPPELETKMNITKGGLVL

SEQ ID NO: 63581 - protein, 78 aa, Homo sapiens; identical to SEQ ID NO: 63566
  Payload ID: 12684
  Gene Symbol: PRPSAP2
  Gene Name: phosphoribosyl pyrophosphate synthetase-associated protein 2
  ENSP ID: ENSP00000459727

SEQ ID NO: 63582 - protein, 93 aa, Homo sapiens
  Payload ID: 12684
  Gene Symbol: PRPSAP2
  Gene Name: phosphoribosyl pyrophosphate synthetase-associated protein 2
  ENSP ID: ENSP00000460138
MFCVTPPELETKMNITKGGLVLFSANSNSSCMELSKKIAERLGVEMGKVQVYQEPNRETRVQIQESVRGKDVFIIQTVSKDVNTTIMELLIMV

SEQ ID NO: 63583 - protein, 57 aa, Homo sapiens
  Payload ID: 12684
  Gene Symbol: PRPSAP2
  Gene Name: phosphoribosyl pyrophosphate synthetase-associated protein 2
  ENSP ID: ENSP00000460324
MFCVTPPELETKMNITKGGLVLFSANSNSSCMELSKKIAENKSTNSRVCEGKRCFHH

SEQ ID NO: 63584 - protein, 78 aa, Homo sapiens; identical to SEQ ID NO: 63566
  Payload ID: 12684
  Gene Symbol: PRPSAP2
  Gene Name: phosphoribosyl pyrophosphate synthetase-associated protein 2
  ENSP ID: ENSP00000460584

SEQ ID NO: 63585 - protein, 176 aa, Homo sapiens; identical to SEQ ID NO: 63572
  Payload ID: 12684
  Gene Symbol: PRPSAP2
  Gene Name: phosphoribosyl pyrophosphate synthetase-associated protein 2
  ENSP ID: ENSP00000460967

SEQ ID NO: 63586 - protein, 143 aa, Homo sapiens
  Payload ID: 12684
  Gene Symbol: PRPSAP2
  Gene Name: phosphoribosyl pyrophosphate synthetase-associated protein 2
  ENSP ID: ENSP00000461241
  MOD_RES (1)..(1): Any amino acid
XEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEICLFWTFHINEIIQCVVFCVWLSSLNIIFSRFIHVGA

SEQ ID NO: 63587 - protein, 47 aa, Homo sapiens; identical to SEQ ID NO: 63579
  Payload ID: 12684
  Gene Symbol: PRPSAP2
  Gene Name: phosphoribosyl pyrophosphate synthetase-associated protein 2
  ENSP ID: ENSP00000461782

SEQ ID NO: 63588 - protein, 283 aa, Homo sapiens; identical to SEQ ID NO: 63576
  Payload ID: 12684
  Gene Symbol: PRPSAP2
  Gene Name: phosphoribosyl pyrophosphate synthetase-associated protein 2
  Uniprot ID: O60256
  ENSP ID: ENSP00000481322

SEQ ID NO: 63589 - protein, 47 aa, Homo sapiens; identical to SEQ ID NO: 63579
  Payload ID: 12684
  Gene Symbol: PRPSAP2
  Gene Name: phosphoribosyl pyrophosphate synthetase-associated protein 2
  ENSP ID: ENSP00000487485

SEQ ID NO: 63590 - protein, 225 aa, Homo sapiens
  Payload ID: 12685
  Gene Symbol: PRTFDC1
  Gene Name: phosphoribosyl transferase domain containing 1
  Uniprot ID: Q9NRG1
  ENSP ID: ENSP00000318602
MAGSSEEAPDYGRGVVIMDDWPGYDLNLFTYPQHYYGDLEYVLIPHGIIVDRIERLAKDIMKDIGYSDIMVLCVLKGGYKFCADLVEHLKNISRNSDRFVSMKVDFIRLKSYRNDQSMGEMQIIGGDDLSTLAGKNVLIVEDVVGTGRTMKALLSNIEKYKPNMIKVASLLVKRTSRSDGFRPDYAGFEIPNLFVVGYALDYNEYFRDLNHICVINEHGKEKYRV

SEQ ID NO: 63591 - protein, 173 aa, Homo sapiens
  Payload ID: 12685
  Gene Symbol: PRTFDC1
  Gene Name: phosphoribosyl transferase domain containing 1
  Uniprot ID: Q9NRG1
  ENSP ID: ENSP00000365556
MAGSSEEAPDYGRGVVIMDDWPGYDLNLFTYPQHYYGDLEYVLIPHGIIVDRIERLAKDIMKDIGYSDIMVLCVLKGGYKFCADLVEHLKNISRNSDRFVSMKVDFIRLKSYRLRARLKRTTICDRGGLAFSQGYMSSCAPLQESPNTLWRGYLQVLIPCFHIRFQLPRSEQN

SEQ ID NO: 63592 - protein, 190 aa, Homo sapiens
  Payload ID: 12685
  Gene Symbol: PRTFDC1
  Gene Name: phosphoribosyl transferase domain containing 1
  Uniprot ID: Q9NRG1
  ENSP ID: ENSP00000365558
MAGSSEEAPDYGRGVVIMDDWPGYDLNLFTYPQHYYGDLEYVLIPHGIIVDRIERLAKDIMKDIGYSDIMVLCVLKGGYKFCADLVEHLKNISRNSDRFVSMKVDFIRLKSYRNDQSMGEMQIIGGDDLSTLAGKNVLIVEDVVGTGRTMKALLSNIEKYKPNMIKVASLLVKRTSRSDGFRPDSHMRHQ

SEQ ID NO: 63593 - protein, 425 aa, Homo sapiens
  Payload ID: 12686
  Gene Symbol: PAICS
  Gene Name: phosphoribosylaminoimidazole carboxylase, phosphoribosylaminoimidazole succinocarboxamide synthetase
  Uniprot ID: P22234
  ENSP ID: ENSP00000264221
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 63594 - protein, 432 aa, Homo sapiens
  Payload ID: 12686
  Gene Symbol: PAICS
  Gene Name: phosphoribosylaminoimidazole carboxylase, phosphoribosylaminoimidazole succinocarboxamide synthetase
  Uniprot ID: P22234
  ENSP ID: ENSP00000382595
MATAEVLNIGKKLYEGKTKEVYELLDSPGKVLLQSKDQITAGNAARKNHLEGKAAISNKITSCIFQLLQEAVTSYKSNRIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 63595 - protein, 425 aa, Homo sapiens; identical to SEQ ID NO: 63593
  Payload ID: 12686
  Gene Symbol: PAICS
  Gene Name: phosphoribosylaminoimidazole carboxylase, phosphoribosylaminoimidazole succinocarboxamide synthetase
  Uniprot ID: P22234
  ENSP ID: ENSP00000421096

SEQ ID NO: 63596 - protein, 413 aa, Homo sapiens
  Payload ID: 12686
  Gene Symbol: PAICS
  Gene Name: phosphoribosylaminoimidazole carboxylase, phosphoribosylaminoimidazole succinocarboxamide synthetase
  ENSP ID: ENSP00000424053
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISL

SEQ ID NO: 63597 - protein, 333 aa, Homo sapiens
  Payload ID: 12686
  Gene Symbol: PAICS
  Gene Name: phosphoribosylaminoimidazole carboxylase, phosphoribosylaminoimidazole succinocarboxamide synthetase
  ENSP ID: ENSP00000424907
MIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 63598 - protein, 1338 aa, Homo sapiens
  Payload ID: 12687
  Gene Symbol: PFAS
  Gene Name: phosphoribosylformylglycinamidine synthase
  Uniprot ID: O15067
  ENSP ID: ENSP00000313490
MSPVLHFYVRPSGHEGAAPGHTRRKLQGKLPELQGVETELCYNVNWTAEALPSAEETKKLMWLFGCPLLLDDVARESWLLPGSNDLLLEVGPRLNFSTPTSTNIVSVCRATGLGPVDRVETTRRYRLSFAHPPSAEVEAIALATLHDRMTEQHFPHPIQSFSPESMPEPLNGPINILGEGRLALEKANQELGLALDSWDLDFYTKRFQELQRNPSTVEAFDLAQSNSEHSRHWFFKGQLHVDGQKLVHSLFESIMSTQESSNPNNVLKFCDNSSAIQGKEVRFLRPEDPTRPSRFQQQQGLRHVVFTAETHNFPTGVCPFSGATTGTGGRIRDVQCTGRGAHVVAGTAGYCFGNLHIPGYNLPWEDPSFQYPGNFARPLEVAIEASNGASDYGNKFGEPVLAGFARSLGLQLPDGQRREWIKPIMFSGGIGSMEADHISKEAPEPGMEVVKVGGPVYRIGVGGGAASSVQVQGDNTSDLDFGAVQRGDPEMEQKMNRVIRACVEAPKGNPICSLHDQGAGGNGNVLKELSDPAGAIIYTSRFQLGDPTLNALEIWGAEYQESNALLLRSPNRDFLTHVSARERCPACFVGTITGDRRIVLVDDRECPVRRNGQGDAPPTPLPTPVDLELEWVLGKMPRKEFFLQRKPPMLQPLALPPGLSVHQALERVLRLPAVASKRYLTNKVDRSVGGLVAQQQCVGPLQTPLADVAVVALSHEELIGAATALGEQPVKSLLDPKVAARLAVAEALTNLVFALVTDLRDVKCSGNWMWAAKLPGEGAALADACEAMVAVMAALGVAVDGGKDSLSMAARVGTETVRAPGSLVISAYAVCPDITATVTPDLKHPEGRGHLLYVALSPGQHRLGGTALAQCFSQLGEHPPDLDLPENLVRAFSITQGLLKDRLLCSGHDVSDGGLVTCLLEMAFAGNCGLQVDVPVPRVDVLSVLFAEEPGLVLEVQEPDLAQVLKRYRDAGLHCLELGHTGEAGPHAMVRVSVNGAVVLEEPVGELRALWEETSFQLDRLQAEPRCVAEEERGLRERMGPSYCLPPTFPKASVPREPGGPSPRVAILREEGSNGDREMADAFHLAGFEVWDVTMQDLCSGAIGLDTFRGVAFVGGFSYADVLGSAKGWAAAVTFHPRAGAELRRFRKRPDTFSLGVCNGCQLLALLGWVGGDPNEDAAEMGPDSQPARPGLLLRHNLSGRYESRWASVRVGPGPALMLRGMEGAVLPVWSAHGEGYVAFSSPELQAQIEARGLAPLHWADDDGNPTEQYPLNPNGSPGGVAGICSCDGRHLAVMPHPERAVRPWQWAWRPPPFDTLTTSPWLQLFINARNWTLEGSC

SEQ ID NO: 63599 - protein, 385 aa, Homo sapiens
  Payload ID: 12687
  Gene Symbol: PFAS
  Gene Name: phosphoribosylformylglycinamidine synthase
  ENSP ID: ENSP00000443244
  MOD_RES (1)..(1): Any amino acid
XLLKDRLLCSGHDVSDGGLVTCLLEMAFAGNCGLQVDVPVPRVDVLSVLFAEEPGLVLEVQEPDLAQVLKRYRDAGLHCLELGHTGEAGPHAMVRVSVNGAVVLEEPVGELRALWEETSFQLDRLQAEPRCVAEEERGLRERMGPSYCLPPTFPKASVPREPGGPSPRVAILREEGSNGDREMADAFHLAGFEVWDVTMQDLCSGAIGLDTFRGVAFVGGFSYADVLGSAKGWAAAVTFHPRAGAELRRFRKRPDTFSLGVCNGCQLLALLGWVGGDPNEDAAEMGPDSQPARPGLLLRHNLSGRYESRWASVRVGPGPALMLRGMEGAVLPVWSAHGEGQAQGRLGEGPRVGGKGGHEGPWLSLPSSFHPRLRSIFFSGTPSSD

SEQ ID NO: 63600 - protein, 116 aa, Homo sapiens
  Payload ID: 12687
  Gene Symbol: PFAS
  Gene Name: phosphoribosylformylglycinamidine synthase
  ENSP ID: ENSP00000462874
  MOD_RES (1)..(1): Any amino acid
XMEVVKVGGPVYRIGVGGGAASSVQVQGDNTSDLDFGAVQRGDPEMEQKMNRVIRACVEAPKGNPICSLHDQGAGGNGNVLKELSDPAGAIIYTSRFQIVLVDDRECPVRRNGQGD

SEQ ID NO: 63601 - protein, 103 aa, Homo sapiens
  Payload ID: 12687
  Gene Symbol: PFAS
  Gene Name: phosphoribosylformylglycinamidine synthase
  ENSP ID: ENSP00000463045
MSPVLHFYVRPSGHEGAAPGHTRRKLQGKLPELQGVETELCYNVNWTAEALPSAEETKKLMWLFGCPLLLDDVARESWLLPGSNDLLLEVGPRLNFSTPTSTN

SEQ ID NO: 63602 - protein, 62 aa, Homo sapiens
  Payload ID: 12687
  Gene Symbol: PFAS
  Gene Name: phosphoribosylformylglycinamidine synthase
  ENSP ID: ENSP00000463103
  MOD_RES (1)..(1): Any amino acid
XNLVRAFSITQGLLKDRLLCSGHDVSDGGLVTCLLEMAFAGNCGLQVDVPVPRVDAELDGTG

SEQ ID NO: 63603 - protein, 87 aa, Homo sapiens
  Payload ID: 12687
  Gene Symbol: PFAS
  Gene Name: phosphoribosylformylglycinamidine synthase
  ENSP ID: ENSP00000463362
MSPVLHFYVRPSGHEGAAPGHTRRKLQGKLPELQGVETELCYNVNWTAEALPSAEETKKLMWLFGCPLLLDDVARESWLLPGSNDLL

SEQ ID NO: 63604 - protein, 131 aa, Homo sapiens
  Payload ID: 12687
  Gene Symbol: PFAS
  Gene Name: phosphoribosylformylglycinamidine synthase
  ENSP ID: ENSP00000464671
MSPVLHFYVRPSGHEGAAPGHTRRKLQGKLPELQGVETELCYNVNWTAEALPSAEETKKLMWLFGCPLLLDDVARESWLLPGSNDLLLEVGPRLNFSTPTSTNIVSVCRATGLGPVDRVETTRRYRLSVWL

SEQ ID NO: 63605 - protein, 135 aa, Homo sapiens
  Payload ID: 12687
  Gene Symbol: PFAS
  Gene Name: phosphoribosylformylglycinamidine synthase
  ENSP ID: ENSP00000464689
MSPVLHFYVRPSGHEGAAPGHTRRKLQGKLPELQGVETELCYNVNWTAEALPSAEETKKLMWLFGCPLLLDDVARESWLLPGSNDLLLEVGPRLNFSTPTSTNIVSVCRATGLGPVDRVETTRRYRLSFAHPPSA

SEQ ID NO: 63606 - protein, 131 aa, Homo sapiens; identical to SEQ ID NO: 63604
  Payload ID: 12687
  Gene Symbol: PFAS
  Gene Name: phosphoribosylformylglycinamidine synthase
  ENSP ID: ENSP00000487260

SEQ ID NO: 63607 - protein, 433 aa, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENSP ID: ENSP00000354388
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVILPLLKSDLYEVIQSTLDGLLCTSLPVWLENHTALTVVMASKGYPGDYTKGVEITGFPEAQALGLEVFHAGTALKNGKVVTHGGRVLAVTAIRENLISALEEAKKGLAAIKFEGAIYRKDVGFRAIAFLQQPR

SEQ ID NO: 63608 - protein, 1010 aa, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENSP ID: ENSP00000371236
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVILPLLKSDLYEVIQSTLDGLLCTSLPVWLENHTALTVVMASKGYPGDYTKGVEITGFPEAQALGLEVFHAGTALKNGKVVTHGGRVLAVTAIRENLISALEEAKKGLAAIKFEGAIYRKDVGFRAIAFLQQPRSLTYKESGVDIAAGNMLVKKIQPLAKATSRSGCKVDLGGFAGLFDLKAAGFKDPLLASGTDGVGTKLKIAQLCNKHDTIGQDLVAMCVNDILAQGAEPLFFLDYFSCGKLDLSVTEAVVAGIAKACGKAGCALLGGETAEMPDMYPPGEYDLAGFAVGAMERDQKLPHLERITEGDVVVGIASSGLHSNGFSLVRKIVAKSSLQYSSPAPDGCGDQTLGDLLLTPTRIYSHSLLPVLRSGHVKAFAHITGGGLLENIPRVLPEKLGVDLDAQTWRIPRVFSWLQQEGHLSEEEMARTFNCGVGAVLVVSKEQTEQILRDIQQHKEEAWVIGSVVARAEGSPRVKVKNLIESMQINGSVLKNGSLTNHFSFEKKKARVAVLISGTGSNLQALIDSTREPNSSAQIDIVISNKAAVAGLDKAERAGIPTRVINHKLYKNRVEFDSAIDLVLEEFSIDIVCLAGFMRILSGPFVQKWNGKMLNIHPSLLPSFKGSNAHEQALETGVTVTGCTVHFVAEDVDAGQIILQEAVPVKRGDTVATLSERVKLAEHKIFPAALQLVASGTVQLGENGKICWVKEE

SEQ ID NO: 63609 - protein, 1010 aa, Homo sapiens; identical to SEQ ID NO: 63608
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENSP ID: ENSP00000371253

SEQ ID NO: 63610 - protein, 1010 aa, Homo sapiens; identical to SEQ ID NO: 63608
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENSP ID: ENSP00000371261

SEQ ID NO: 63611 - protein, 306 aa, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENSP ID: ENSP00000390003
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVGNPPTS

SEQ ID NO: 63612 - protein, 231 aa, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENSP ID: ENSP00000398631
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTG

SEQ ID NO: 63613 - protein, 136 aa, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENSP ID: ENSP00000407783
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSF

SEQ ID NO: 63614 - protein, 145 aa, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENSP ID: ENSP00000409771
  MOD_RES (1)..(1): Any amino acid
XQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQIKNRPGAVAHACNPSTLGGRGRWIT

SEQ ID NO: 63615 - protein, 241 aa, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENSP ID: ENSP00000413040
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQ

SEQ ID NO: 63616 - protein, 138 aa, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENSP ID: ENSP00000413803
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFIL

SEQ ID NO: 63617 - protein, 308 aa, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENSP ID: ENSP00000459391
  MOD_RES (1)..(1): Any amino acid
XAQTWRIPRVFSWLQQEGHLSEEEMARTFNCGVGAVLVVSKEQTEQILRDIQQHKEEAWVIGSVVARAEGSPRVKVKNLIESMQINGSVLKNGSLTNHFSFEKKKARVAVLISGTGSNLQALIDSTREPNSSAQIDIVISNKAAVAGLDKAERAGIPTRVINHKLYKNRVEFDSAIDLVLEEFSIDIVCLAGFMRILSGPFVQKWNGKMLNIHPSLLPSFKGSNAHEQALETGVTVTGCTVHFVAEDVDAGQIILQEAVPVKRGDTVATLSERVKLAEHKIFPAALQLVASGTVQLGENGKICWVKEE

SEQ ID NO: 63618 - protein, 308 aa, Homo sapiens; identical to SEQ ID NO: 63617
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENSP ID: ENSP00000459532
  MOD_RES (1)..(1): Any amino acid

SEQ ID NO: 63619 - protein, 223 aa, Homo sapiens
  Payload ID: 12688
  Gene Symbol: GART
  Gene Name: phosphoribosylglycinamide formyltransferase, phosphoribosylglycinamide synthetase, phosphoribosylaminoimidazole syntheta se
  ENSP ID: ENSP00000461360
AVLVVSKEQTEQILRDIQQHKEEAWVIGSVVARAEGSPRVKVKNLIESMQINGSVLKNGSLTNHFSFEKKKARVAVLISGTGSNLQALIDSTREPNSSAQIDIVISNKAAVAGLDKAERAGIPTRVINHKLYKNRVEFDSAIDLVLEEFSIDIVCLAGFMRILSGPFVQKWNGKMLNIHPSLLPSFKGSNAHEQALETGVTVTGCTVHFVAMEFHSVTQAGVE

SEQ ID NO: 63620 - protein, 308 aa, Homo sapiens; identical to SEQ ID NO: 63617
  Payload ID: 12688
  Gene Symbol: GART
  Gene Name: phosphoribosylglycinamide formyltransferase, phosphoribosylglycinamide synthetase, phosphoribosylaminoimidazole syntheta se
  Uniprot ID: P22102
  ENSP ID: ENSP00000461700
  MOD_RES (1)..(1): Any amino acid

SEQ ID NO: 63621 - protein, 1210 aa, Homo sapiens
  Payload ID: 12689
  Gene Symbol: PHKA1
  Gene Name: phosphorylase kinase, alpha 1 (muscle)
  Uniprot ID: P46020
  ENSP ID: ENSP00000342469
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 63622 - protein, 1240 aa, Homo sapiens
  Payload ID: 12689
  Gene Symbol: PHKA1
  Gene Name: phosphorylase kinase, alpha 1 (muscle)
  ENSP ID: ENSP00000362640
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQVEFRRLSISAESQSNGGHPLGIDLMSPSFMSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 63623 - protein, 1223 aa, Homo sapiens
  Payload ID: 12689
  Gene Symbol: PHKA1
  Gene Name: phosphorylase kinase, alpha 1 (muscle)
  Uniprot ID: P46020
  ENSP ID: ENSP00000362643
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQVEFRRLSISAESQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 63624 - protein, 1181 aa, Homo sapiens
  Payload ID: 12689
  Gene Symbol: PHKA1
  Gene Name: phosphorylase kinase, alpha 1 (muscle)
  ENSP ID: ENSP00000362646
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHDVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQVEFRRLSISAESQSNGGHPLGIDLMSPSFMSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 63625 - protein, 1151 aa, Homo sapiens
  Payload ID: 12689
  Gene Symbol: PHKA1
  Gene Name: phosphorylase kinase, alpha 1 (muscle)
  Uniprot ID: P46020
  ENSP ID: ENSP00000441251
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHDVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 63626 - protein, 1235 aa, Homo sapiens
  Payload ID: 12690
  Gene Symbol: PHKA2
  Gene Name: phosphorylase kinase, alpha 2 (liver)
  Uniprot ID: P46019
  ENSP ID: ENSP00000369274
MRSRSNSGVRLDGYARLVQQTILCYQNPVTGLLSASHEQKDAWVRDNIYSILAVWGLGMAYRKNADRDEDKAKAYELEQNVVKLMRGLLQCMMRQVAKVEKFKHTQSTKDSLHAKYNTATCGTVVGDDQWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFSGDAVQVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSVRPIHSSTSSPTISIHEVGHTGVTKTERSGINRLRSEMKQMTRRFSADEQFFSVGQAASSSAHSSKSARSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 63627 - protein, 1093 aa, Homo sapiens
  Payload ID: 12691
  Gene Symbol: PHKB
  Gene Name: phosphorylase kinase, beta
  Uniprot ID: Q93100
  ENSP ID: ENSP00000299167
MAGAAGLTAEVSWKVLERRARTKRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWSVVRRAASLLSKVVDSLAPSITNVLVQGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 63628 - protein, 1093 aa, Homo sapiens
  Payload ID: 12691
  Gene Symbol: PHKB
  Gene Name: phosphorylase kinase, beta
  Uniprot ID: Q93100
  ENSP ID: ENSP00000313504
MAGAAGLTAEVSWKVLERRARTKRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWLAVRYGAAFTQKFSSSIAPHITTFLVHGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 63629 - protein, 229 aa, Homo sapiens
  Payload ID: 12691
  Gene Symbol: PHKB
  Gene Name: phosphorylase kinase, beta
  ENSP ID: ENSP00000455664
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHS

SEQ ID NO: 63630 - protein, 1086 aa, Homo sapiens
  Payload ID: 12691
  Gene Symbol: PHKB
  Gene Name: phosphorylase kinase, beta
  Uniprot ID: Q93100
  ENSP ID: ENSP00000456729
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSSSVGLAKAALEAINGFNLFGNQGCSWSVIFVDLDAHNRNRQTLCSLLPRESRSHNTDAALLPCISYPAFALDDEVLFSQTLDKVVRKLKGKYGFKRFLRDGYRTSLEDPNRCYYKPAEIKLFDGIECEFPIFFLYMMIDGVFRGNPKQVQEYQDLLTPVLHHTTEGYPVVPKYYYVPADFVEYEKNNPGSQKRFPSNCGRDGKLFLWGQALYIIAKLLADELISPKDIDPVQRYVPLKDQRNVSMRFSNQGPLENDLVVHVALIAESQRLQVFLNTYGIQTQTPQQVEPIQIWPQQELVKAYLQLGINEKLGLSGRPDRPIGCLGTSKIYRILGKTVVCYPIIFDLSDFYMSQDVFLLIDDIKNALQFIKQYWKMHGRPLFLVLIREDNIRGSRFNPILDMLAALKKGIIGGVKVHVDRLQTLISGAVVEQLDFLRISDTEELPEFKSFEELEPPKHSKVKRQSSTPSAPELGQQPDVNISEWKDKPTHEILQKLNDCSCLASQAILLGILLKREGPNFITKEGTVSDHIERVYRRAGSQKLWSVVRRAASLLSKVVDSLAPSITNVLVQGKQVTLGAFGHEEEVISNPLSPRVIQNIIYYKCNTHDEREAVIQQELVIHIGWIISNNPELFSGMLKIRIGWIIHAMEYELQIRGGDKPALDLYQLSPSEVKQLLLDILQPQQNGRCWLNRRQIDGSLNRTPTGFYDRVWQILERTPNGIIVAGKHLPQQPTLSDMTMYEMNFSLLVEDTLGNIDQPQYRQIVVELLMVVSIVLERNPELEFQDKVDLDRLVKEAFNEFQKDQSRLKEIEKQDDMTSFYNTPPLGKRGTCSYLTKAVMNLLLEGEVKPNNDDPCLIS

SEQ ID NO: 63631 - protein, 150 aa, Homo sapiens
  Payload ID: 12691
  Gene Symbol: PHKB
  Gene Name: phosphorylase kinase, beta
  ENSP ID: ENSP00000457905
MACSPDAVVSPSSAFLRSGSVYEPLKSINLPRPDNETLWDKLDHYYRIVKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHT

SEQ ID NO: 63632 - protein, 76 aa, Homo sapiens
  Payload ID: 12691
  Gene Symbol: PHKB
  Gene Name: phosphorylase kinase, beta
  ENSP ID: ENSP00000458446
  MOD_RES (1)..(1): Any amino acid
XKNNPGSQKRFPSNCGRDGKLFLWGQALYIIAKLLADELISPKDIDPVQRYVPLKDQRNVSMRFSNQVDNVSLREV

SEQ ID NO: 63633 - protein, 10 aa, Homo sapiens
  Payload ID: 12691
  Gene Symbol: PHKB
  Gene Name: phosphorylase kinase, beta
  ENSP ID: ENSP00000458581
MACSPDAVVS

SEQ ID NO: 63634 - protein, 78 aa, Homo sapiens
  Payload ID: 12691
  Gene Symbol: PHKB
  Gene Name: phosphorylase kinase, beta
  ENSP ID: ENSP00000458961
  MOD_RES (1)..(1): Any amino acid
XQIVVELLMVVSIVLERNPELEFQDKVDLDRLVKEAFNEFQKDQSRLKEIEKQLTQILPVNSLQTEDRMPCLLFSFVG

SEQ ID NO: 63635 - protein, 210 aa, Homo sapiens
  Payload ID: 12691
  Gene Symbol: PHKB
  Gene Name: phosphorylase kinase, beta
  ENSP ID: ENSP00000459287
SKVKRQSSTPSAPELGQQPDVNISEWKDKPTHEILQKLNDCSCLASQAILLGILLKREGPNFITKEGTVSDHIERVYRRAGSQKLWSVVRRAASLLSKVVDSLAPSITNVLVQGKQVTLGAFGHEEEVISNPLSPRVIQNIIYYKCNTHDEREAVIQQELVIHIGWIISNNPELFSGMLKIRIGFAKAVCSHKRSSPWRRGPFQPWLSPL

SEQ ID NO: 63636 - protein, 73 aa, Homo sapiens
  Payload ID: 12691
  Gene Symbol: PHKB
  Gene Name: phosphorylase kinase, beta
  ENSP ID: ENSP00000460408
MACSPDAVVSPSSAFLRSGSVYEPLKSINLPRPDNETLWDKLDHYYRIVKSTLLLYQSPTTGLFPTKTCGGDQ

SEQ ID NO: 63637 - protein, 187 aa, Homo sapiens
  Payload ID: 12691
  Gene Symbol: PHKB
  Gene Name: phosphorylase kinase, beta
  ENSP ID: ENSP00000461770
  MOD_RES (1)..(1): Any amino acid
XKSTLLLYQSPTTGLFPTKTCGGDQKAKIQDSLYCAAGAWALALAYRRIDDDKGRTHELEHSAIKCMRGILYCYMRQADKVQQFKQDPRPTTCLHSVFNVHTGDELLSYEEYGHLQINAVSLYLLYLVEMISSGLQIIYNTDEVSFIQNLVFCVERVYRVPDFGVWERGSKYNNGSTELHSRISCTW

SEQ ID NO: 63638 - protein, 387 aa, Homo sapiens
  Payload ID: 12692
  Gene Symbol: PHKG1
  Gene Name: phosphorylase kinase, gamma 1 (muscle)
  Uniprot ID: Q16816
  ENSP ID: ENSP00000297373
MTRDEALPDSHSAQDFYENYEPKEILGRGVSSVVRRCIHKPTSQEYAVKVIDVTGGGSFSPEEVRELREATLKEVDILRKVSGHPNIIQLKDTYETNTFFFLVFDLMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 63639 - protein, 88 aa, Homo sapiens
  Payload ID: 12692
  Gene Symbol: PHKG1
  Gene Name: phosphorylase kinase, gamma 1 (muscle)
  ENSP ID: ENSP00000378817
MTRDEALPDSHSAQDFYENYEPKEILGRGVSSVVRRCIHKPTSQEYAVKVIDVTGGGSFSPEEVRELREATLKEVDILRKVSGHPNIR

SEQ ID NO: 63640 - protein, 117 aa, Homo sapiens
  Payload ID: 12692
  Gene Symbol: PHKG1
  Gene Name: phosphorylase kinase, gamma 1 (muscle)
  ENSP ID: ENSP00000389721
MTRDEALPDSHSAQDFYENYEPKEILGRMKRGELFDYLTEKVTLSEKETRKIMRALLEVICTLHKLNIVHRDLKPENILLDDNMNIKLTDFGFSCQLEPGERLRGLPIPGGATPEPL

SEQ ID NO: 63641 - protein, 145 aa, Homo sapiens
  Payload ID: 12692
  Gene Symbol: PHKG1
  Gene Name: phosphorylase kinase, gamma 1 (muscle)
  ENSP ID: ENSP00000397193
MTRDEALPDSHSAQDFYENYEPKEILGRMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTL

SEQ ID NO: 63642 - protein, 390 aa, Homo sapiens [sequence omitted]

SEQ ID NO: 63643 - protein, 419 aa, Homo sapiens
  Payload ID: 12692
  Gene Symbol: PHKG1
  Gene Name: phosphorylase kinase, gamma 1 (muscle)
  Uniprot ID: Q16816
  ENSP ID: ENSP00000445440
MTRDEALPDSHSAQDFYENYEPKEILGRGVSSVVRRCIHKPTSQEYAVKVIDVTGGGSFSPEEVRELREATLKEVDILRKVSGHPNIIQLKDTYETNTFFFLVFDLWEDTDTMEMEQKWCLGWDSPKSTNFRAQGRARMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 63644 - protein, 410 aa, Homo sapiens
  Payload ID: 12693
  Gene Symbol: PHKG2
  Gene Name: phosphorylase kinase, gamma 2 (testis)
  ENSP ID: ENSP00000329968
MTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLLFPSWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 63645 - protein, 374 aa, Homo sapiens
  Payload ID: 12693
  Gene Symbol: PHKG2
  Gene Name: phosphorylase kinase, gamma 2 (testis)
  Uniprot ID: P15735
  ENSP ID: ENSP00000388571
MTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWIRKQWIGKLMACV

SEQ ID NO: 63646 - protein, 87 aa, Homo sapiens
  Payload ID: 12693
  Gene Symbol: PHKG2
  Gene Name: phosphorylase kinase, gamma 2 (testis)
  ENSP ID: ENSP00000454641
MTLDVGPEDELPDWAAAKEFYQKYDPKDVIGRGVSSVVRRCVHRATGHEFAVKIMEVTAERLSPEQLEESPSSIPTSLLASCSWCLT

SEQ ID NO: 63647 - protein, 254 aa, Homo sapiens
  Payload ID: 12693
  Gene Symbol: PHKG2
  Gene Name: phosphorylase kinase, gamma 2 (testis)
  ENSP ID: ENSP00000455091
MTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSS

SEQ ID NO: 63648 - protein, 406 aa, Homo sapiens
  Payload ID: 12693
  Gene Symbol: PHKG2
  Gene Name: phosphorylase kinase, gamma 2 (testis)
  Uniprot ID: P15735
  ENSP ID: ENSP00000455607
MTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 63649 - protein, 80 aa, Homo sapiens
  Payload ID: 12693
  Gene Symbol: PHKG2
  Gene Name: phosphorylase kinase, gamma 2 (testis)
  ENSP ID: ENSP00000457194
  MOD_RES (1)..(1): Any amino acid
XMRKGELFDYLTEKVALSEKETRSIMRSLLEAVSFLHANNIVHRDLKPENILLDDNMQIRLSDFGFSCHLEPGEKLRGRQ

SEQ ID NO: 63650 - protein, 266 aa, Homo sapiens
  Payload ID: 12693
  Gene Symbol: PHKG2
  Gene Name: phosphorylase kinase, gamma 2 (testis)
  ENSP ID: ENSP00000457359
MTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKD

SEQ ID NO: 63651 - protein, 847 aa, Homo sapiens
  Payload ID: 12694
  Gene Symbol: PYGL
  Gene Name: phosphorylase, glycogen, liver
  Uniprot ID: P06737
  ENSP ID: ENSP00000216392
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 63652 - protein, 819 aa, Homo sapiens
  Payload ID: 12694
  Gene Symbol: PYGL
  Gene Name: phosphorylase, glycogen, liver
  ENSP ID: ENSP00000431657
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMKSDAVRPKHWPGKDSVQTGPLRETVR

SEQ ID NO: 63653 - protein, 813 aa, Homo sapiens
  Payload ID: 12694
  Gene Symbol: PYGL
  Gene Name: phosphorylase, glycogen, liver
  Uniprot ID: P06737
  ENSP ID: ENSP00000443787
MAKPLTDQEKRRQISIRGIVGVENVAELKKSFNRHLHFTLVKDRNVATTRDYYFALAHTVRDHLVGRWIRTQQHYYDKCPKLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 63654 - protein, 842 aa, Homo sapiens
  Payload ID: 12695
  Gene Symbol: PYGM
  Gene Name: phosphorylase, glycogen, muscle
  Uniprot ID: P11217
  ENSP ID: ENSP00000164139
MSRPLSDQEKRKQISVRGLAGVENVTELKKNFNRHLHFTLVKDRNVATPRDYYFALAHTVRDHLVGRWIRTQQHYYEKDPKRIYYLSLEFYMGRTLQNTMVNLALENACDEATYQLGLDMEELEEIEEDAGLGNGGLGRLAACFLDSMATLGLAAYGYGIRYEFGIFNQKISGGWQMEEADDWLRYGNPWEKARPEFTLPVHFYGHVEHTSQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCRDPVRTNFDAFPDKVAIQLNDTHPSLAIPELMRILVDLERMDWDKAWDVTVRTCAYTNHTVLPEALERWPVHLLETLLPRHLQIIYEINQRFLNRVAAAFPGDVDRLRRMSLVEEGAVKRINMAHLCIAGSHAVNGVARIHSEILKKTIFKDFYELEPHKFQNKTNGITPRRWLVLCNPGLAEVIAERIGEDFISDLDQLRKLLSFVDDEAFIRDVAKVKQENKLKFAAYLEREYKVHINPNSLFDIQVKRIHEYKRQLLNCLHVITLYNRIKREPNKFFVPRTVMIGGKAAPGYHMAKMIIRLVTAIGDVVNHDPAVGDRLRVIFLENYRVSLAEKVIPAADLSEQISTAGTEASGTGNMKFMLNGALTIGTMDGANVEMAEEAGEENFFIFGMRVEDVDKLDQRGYNAQEYYDRIPELRQVIEQLSSGFFSPKQPDLFKDIVNMLMHHDRFKVFADYEDYIKCQEKVSALYKNPREWTRMVIRNIATSGKFSSDRTIAQYAREIWGVEPSRQRLPAPDEAI

SEQ ID NO: 63655 - protein, 754 aa, Homo sapiens
  Payload ID: 12695
  Gene Symbol: PYGM
  Gene Name: phosphorylase, glycogen, muscle
  Uniprot ID: P11217
  ENSP ID: ENSP00000366650
MSRPLSDQEKRKQISVRGLAGVENVTELKKNFNRHLHFTLVKDRNVATPRDYYFALAHTVRDHLVGRWIRTQQHYYEKDPKKISGGWQMEEADDWLRYGNPWEKARPEFTLPVHFYGHVEHTSQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCRDPVRTNFDAFPDKVAIQLNDTHPSLAIPELMRILVDLERMDWDKAWDVTVRTCAYTNHTVLPEALERWPVHLLETLLPRHLQIIYEINQRFLNRVAAAFPGDVDRLRRMSLVEEGAVKRINMAHLCIAGSHAVNGVARIHSEILKKTIFKDFYELEPHKFQNKTNGITPRRWLVLCNPGLAEVIAERIGEDFISDLDQLRKLLSFVDDEAFIRDVAKVKQENKLKFAAYLEREYKVHINPNSLFDIQVKRIHEYKRQLLNCLHVITLYNRIKREPNKFFVPRTVMIGGKAAPGYHMAKMIIRLVTAIGDVVNHDPAVGDRLRVIFLENYRVSLAEKVIPAADLSEQISTAGTEASGTGNMKFMLNGALTIGTMDGANVEMAEEAGEENFFIFGMRVEDVDKLDQRGYNAQEYYDRIPELRQVIEQLSSGFFSPKQPDLFKDIVNMLMHHDRFKVFADYEDYIKCQEKVSALYKNPREWTRMVIRNIATSGKFSSDRTIAQYAREIWGVEPSRQRLPAPDEAI

SEQ ID NO: 63656 - protein, 843 aa, Homo sapiens
  Payload ID: 12696
  Gene Symbol: PYGB
  Gene Name: phosphorylase, glycogen
  brain
  Uniprot ID: P11216
  ENSP ID: ENSP00000216962
MAKPLTDSEKRKQISVRGLAGLGDVAEVRKSFNRHLHFTLVKDRNVATPRDYFFALAHTVRDHLVGRWIRTQQHYYERDPKRIYYLSLEFYMGRTLQNTMVNLGLQNACDEAIYQLGLDLEELEEIEEDAGLGNGGLGRLAACFLDSMATLGLAAYGYGIRYEFGIFNQKIVNGWQVEEADDWLRYGNPWEKARPEYMLPVHFYGRVEHTPDGVKWLDTQVVLAMPYDTPVPGYKNNTVNTMRLWSAKAPNDFKLQDFNVGDYIEAVLDRNLAENISRVLYPNDNFFEGKELRLKQEYFVVAATLQDIIRRFKSSKFGCRDPVRTCFETFPDKVAIQLNDTHPALSIPELMRILVDVEKVDWDKAWEITKKTCAYTNHTVLPEALERWPVSMFEKLLPRHLEIIYAINQRHLDHVAALFPGDVDRLRRMSVIEEGDCKRINMAHLCVIGSHAVNGVARIHSEIVKQSVFKDFYELEPEKFQNKTNGITPRRWLLLCNPGLADTIVEKIGEEFLTDLSQLKKLLPLVSDEVFIRDVAKVKQENKLKFSAFLEKEYKVKINPSSMFDVHVKRIHEYKRQLLNCLHVVTLYNRIKRDPAKAFVPRTVMIGGKAAPGYHMAKLIIKLVTSIGDVVNHDPVVGDRLKVIFLENYRVSLAEKVIPAADLSQQISTAGTEASGTGNMKFMLNGALTIGTMDGANVEMAEEAGAENLFIFGLRVEDVEALDRKGYNAREYYDHLPELKQAVDQISSGFFSPKEPDCFKDIVNMLMHHDRFKVFADYEAYMQCQAQVDQLYRNPKEWTKKVIRNIACSGKFSSDRTITEYAREIWGVEPSDLQIPPPNIPRD

SEQ ID NO: 63657 - protein, 245 aa, Homo sapiens
  Payload ID: 12696
  Gene Symbol: PYGB
  Gene Name: phosphorylase, glycogen
  brain
  ENSP ID: ENSP00000395451
  MOD_RES (1)..(1): Any amino acid
XKHHHTVPPSVTPKALDRSPPCPEMFTRAAPGYHMAKLIIKLVTSIGDVVNHDPVVGDRLKVIFLENYRVSLAEKVIPAADLSQQISTAGTEASGTGNMKFMLNGALTIGTMDGANVEMAEEAGAENLFIFGLRVEDVEALDRKGYNAREYYDHLPELKQAVDQISSGFFSPKEPDCFKDIVNMLMHHDRFKVFADYEAYMQCQAQVDQLYRNPKEWTKKVIRNIACSGKFSSDRTITEYAREIW

SEQ ID NO: 63658 - protein, 394 aa, Homo sapiens
  Payload ID: 12697
  Gene Symbol: PHAX
  Gene Name: phosphorylated adaptor for RNA export
  Uniprot ID: Q9H814
  ENSP ID: ENSP00000297540
MALEVGDMEDGQLSDSDSDMTVAPSDRPLQLPKVLGGDSAMRAFQNTATACAPVSHYRAVESVDSSEESFSDSDDDSCLWKRKRQKCFNPPPKPEPFQFGQSSQKPPVAGGKKINNIWGAVLQEQNQDAVATELGILGMEGTIDRSRQSETYNYLLAKKLRKESQEHTKDLDKELDEYMHGGKKMGSKEEENGQGHLKRKRPVKDRLGNRPEMNYKGRYEITAEDSQEKVADEISFRLQEPKKDLIARVVRIIGNKKAIELLMETAEVEQNGGLFIMNGSRRRTPGGVFLNLLKNTPSISEEQIKDIFYIENQKEYENKKAARKRRTQVLGKKMKQAIKSLNFQEDDDTSRETFASDTNEALASLDESQEGHAEAKLEAEEAIEVDHSHDLDIF

SEQ ID NO: 63659 - protein, 324 aa, Homo sapiens
  Payload ID: 12698
  Gene Symbol: PSAT1
  Gene Name: phosphoserine aminotransferase 1
  Uniprot ID: Q9Y617
  ENSP ID: ENSP00000317606
MDAPRQVVNFGPGPAKLPHSVLLEIQKELLDYKGVGISVLEMSHRSSDFAKIINNTENLVRELLAVPDNYKVIFLQGGGCGQFSAVPLNLIGLKAGRCADYVVTGAWSAKAAEEAKKFGTINIVHPKLGSYTKIPDPSTWNLNPDASYVYYCANETVHGVEFDFIPDVKGAVLVCDMSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVSVGGIRASLYNAVTIEDVQKLAAFMKKFLEMHQL

SEQ ID NO: 63660 - protein, 370 aa, Homo sapiens
  Payload ID: 12698
  Gene Symbol: PSAT1
  Gene Name: phosphoserine aminotransferase 1
  Uniprot ID: Q9Y617
  ENSP ID: ENSP00000365773
MDAPRQVVNFGPGPAKLPHSVLLEIQKELLDYKGVGISVLEMSHRSSDFAKIINNTENLVRELLAVPDNYKVIFLQGGGCGQFSAVPLNLIGLKAGRCADYVVTGAWSAKAAEEAKKFGTINIVHPKLGSYTKIPDPSTWNLNPDASYVYYCANETVHGVEFDFIPDVKGAVLVCDMSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVCPVEPQNRSKMNIPFRIGNAKGDDALEKRFLDKALELNMLSLKGHRSVGGIRASLYNAVTIEDVQKLAAFMKKFLEMHQL

SEQ ID NO: 63661 - protein, 225 aa, Homo sapiens
  Payload ID: 12699
  Gene Symbol: PSPH
  Gene Name: phosphoserine phosphatase
  Uniprot ID: P78330
  ENSP ID: ENSP00000275605
MVSHSELRKLFYSADAVCFDVDSTVIREEGIDELAKICGVEDAVSEMTRRAMGGAVPFKAALTERLALIQPSREQVQRLIAEQPPHLTPGIRELVSRLQERNVQVFLISGGFRSIVEHVASKLNIPATNVFANRLKFYFNGEYAGFDETQPTAESGGKGKVIKLLKEKFHFKKIIMIGDGATDMEACPPADAFIGFGGNVIRQQVKDNAKWYITDFVELLGELEE

SEQ ID NO: 63662 - protein, 225 aa, Homo sapiens; identical to SEQ ID NO: 63661
  Payload ID: 12699
  Gene Symbol: PSPH
  Gene Name: phosphoserine phosphatase
  Uniprot ID: P78330
  ENSP ID: ENSP00000378854

SEQ ID NO: 63663 - protein, 10 aa, Homo sapiens
  Payload ID: 12699
  Gene Symbol: PSPH
  Gene Name: phosphoserine phosphatase
  ENSP ID: ENSP00000390452
MVSHSELRKL

SEQ ID NO: 63664 - protein, 46 aa, Homo sapiens
  Payload ID: 12699
  Gene Symbol: PSPH
  Gene Name: phosphoserine phosphatase
  ENSP ID: ENSP00000390952
MVSHSELRKLFYSADAVCFDVDSTVIREEGIDELAKICGVEDAVSE

SEQ ID NO: 63665 - protein, 187 aa, Homo sapiens
  Payload ID: 12699
  Gene Symbol: PSPH
  Gene Name: phosphoserine phosphatase
  ENSP ID: ENSP00000398653
MVSHSELRKLFYSADAVCFDVDSTVIREEGIDELAKICGVEDAVSEMTRRAMGGAVPFKAALTERLALIQPSREQVQRLIAEQPPHLTPGIRELVSRLQERNVQVFLISGGFRSIVEHVASKLNIPATNVFANRLKFYFNGEYAGFDETQPTAESGGKGKVIKLLKEKFHFKKIIMIGDGATDMEAC

SEQ ID NO: 63666 - protein, 46 aa, Homo sapiens; identical to SEQ ID NO: 63664
  Payload ID: 12699
  Gene Symbol: PSPH
  Gene Name: phosphoserine phosphatase
  ENSP ID: ENSP00000399660

SEQ ID NO: 63667 - protein, 225 aa, Homo sapiens; identical to SEQ ID NO: 63661
  Payload ID: 12699
  Gene Symbol: PSPH
  Gene Name: phosphoserine phosphatase
  Uniprot ID: P78330
  ENSP ID: ENSP00000401639

SEQ ID NO: 63668 - protein, 90 aa, Homo sapiens
  Payload ID: 12699
  Gene Symbol: PSPH
  Gene Name: phosphoserine phosphatase
  ENSP ID: ENSP00000403431
MVSHSELRKLFYSADAVCFDVDSTVIREEGIDELAKICGVEDAVSEIPGAVRHVNLEDIGPGWPDCWVSLLGHGEPWAGQCLSKLLSQSA

SEQ ID NO: 63669 - protein, 2 aa, Homo sapiens
  Payload ID: 12699
  Gene Symbol: PSPH
  Gene Name: phosphoserine phosphatase
  ENSP ID: ENSP00000404674
MV

SEQ ID NO: 63670 - protein, 2 aa, Homo sapiens
  Payload ID: 12699
  Gene Symbol: PSPH
  Gene Name: phosphoserine phosphatase
  ENSP ID: ENSP00000405538
MV

SEQ ID NO: 63671 - protein, 348 aa, Homo sapiens
  Payload ID: 12700
  Gene Symbol: PSTK
  Gene Name: phosphoseryl-tRNA kinase
  Uniprot ID: Q8IV42
  ENSP ID: ENSP00000357882
MKTAENIRGTGSDGPRKRGLCVLCGLPAAGKSTFARALAHRLQQEQGWAIGVVAYDDVMPDAFLAGARARPAPSQWKLLRQELLKYLEYFLMAVINGCQMSVPPNRTEAMWEDFITCLKDQDLIFSAAFEAQSCYLLTKTAVSRPLFLVLDDNFYYQSMRYEVYQLARKYSLGFCQLFLDCPLETCLQRNGQRPQALPPETIHLMGRKLEKPNPEKNAWEHNSLTIPSPACASEASLEVTDLLLTALENPVKYAEDNMEQKDTDRIICSTNILHKTDQTLRRIVSQTMKEAKGNQEAFSEMTFKQRWVRANHAAIWRIILGNEHIKCRSAKVGWLQCCRIEKRPLSTG

SEQ ID NO: 63672 - protein, 359 aa, Homo sapiens
  Payload ID: 12700
  Gene Symbol: PSTK
  Gene Name: phosphoseryl-tRNA kinase
  ENSP ID: ENSP00000384653
  MOD_RES (1)..(1): Any amino acid
XMKTAENIRGTGSDGPRKRGLCVLCGLPAAGKSTFARALAHRLQQEQGWAIGVVAYDDVMPDAFLAGARARPAPSQWKLLRQELLKYLEYFLMAVINGCQMSVPPNRTEAMWEDFITCLKDQDLIFSAAFEAQSCYLLTKTAVSRPLFLVLDDNFYYQSMRYEVYQLARKYSLGFCQLFLDCPLETCLQRNGQRPQALPPETIHLMGRKLEKPNPEKNAWEHNSLTIPSPACASEASLEVTDLLLTALENPVKYAEDNMEQKDTDRIICSTNILHKTDQTLRRIVSQTMKEAKDEQVLPHNLKLLAEELNKLKAEFLEDLKQGNKKYLCFQQTIDIPDVISFFHYEKDNIVQKYFSKQH

SEQ ID NO: 63673 - protein, 348 aa, Homo sapiens; identical to SEQ ID NO: 63671
  Payload ID: 12700
  Gene Symbol: PSTK
  Gene Name: phosphoseryl-tRNA kinase
  Uniprot ID: Q8IV42
  ENSP ID: ENSP00000384764

SEQ ID NO: 63674 - protein, 302 aa, Homo sapiens
  Payload ID: 12701
  Gene Symbol: PTER
  Gene Name: phosphotriesterase related
  Uniprot ID: Q96BW5
  ENSP ID: ENSP00000298942
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRVRLLVEEGCEDRILVAHDIHTKTRLMKYGGHGYSHILTNVVPKMLLRGITENVLDKILIENPKQWLTFK

SEQ ID NO: 63675 - protein, 349 aa, Homo sapiens
  Payload ID: 12701
  Gene Symbol: PTER
  Gene Name: phosphotriesterase related
  Uniprot ID: Q96BW5
  ENSP ID: ENSP00000367239
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 63676 - protein, 200 aa, Homo sapiens
  Payload ID: 12701
  Gene Symbol: PTER
  Gene Name: phosphotriesterase related
  ENSP ID: ENSP00000389535
MNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 63677 - protein, 349 aa, Homo sapiens; identical to SEQ ID NO: 63675
  Payload ID: 12701
  Gene Symbol: PTER
  Gene Name: phosphotriesterase related
  Uniprot ID: Q96BW5
  ENSP ID: ENSP00000439485

SEQ ID NO: 63678 - protein, 250 aa, Homo sapiens
  Payload ID: 12702
  Gene Symbol: PID1
  Gene Name: phosphotyrosine interaction domain containing 1
  Uniprot ID: Q7Z2X4
  ENSP ID: ENSP00000283937
MFSLPLSLPLCEDTAFLPSKCCSSHKTIKQARTLIMIFLASGTHFQTMLKSKLNVLTLKKEPLPAVIFHEPEAIELCTTTPLMKTRTHSGCKVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 63679 - protein, 248 aa, Homo sapiens
  Payload ID: 12702
  Gene Symbol: PID1
  Gene Name: phosphotyrosine interaction domain containing 1
  Uniprot ID: Q7Z2X4
  ENSP ID: ENSP00000375907
MPRIAGNHLMLEESRTCSSPELLDGVWPCQPLHFGLPASEMHFQTMLKSKLNVLTLKKEPLPAVIFHEPEAIELCTTTPLMKTRTHSGCKVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 63680 - protein, 217 aa, Homo sapiens
  Payload ID: 12702
  Gene Symbol: PID1
  Gene Name: phosphotyrosine interaction domain containing 1
  Uniprot ID: Q7Z2X4
  ENSP ID: ENSP00000375908
MWQPATERLQHFQTMLKSKLNVLTLKKEPLPAVIFHEPEAIELCTTTPLMKTRTHSGCKVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 63681 - protein, 168 aa, Homo sapiens
  Payload ID: 12702
  Gene Symbol: PID1
  Gene Name: phosphotyrosine interaction domain containing 1
  Uniprot ID: Q7Z2X4
  ENSP ID: ENSP00000386826
MWQPATERLQVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 63682 - protein, 41 aa, Homo sapiens
  Payload ID: 12702
  Gene Symbol: PID1
  Gene Name: phosphotyrosine interaction domain containing 1
  ENSP ID: ENSP00000438228
MWQPATERLQDGCCNSSHNTLVPQYPWGIDSGPLVNTKIYR

SEQ ID NO: 63683 - protein, 338 aa, Homo sapiens
  Payload ID: 12703
  Gene Symbol: PHYH
  Gene Name: phytanoyl-CoA 2-hydroxylase
  Uniprot ID: O14832
  ENSP ID: ENSP00000263038
MEQLRAAARLQIVLGHLGRPSAGAVVAHPTSGTISSASFHPQQFQYTLDNNVLTLEQRKFYEENGFLVIKNLVPDADIQRFRNEFEKICRKEVKPLGLTVMRDVTISKSEYAPSEKMITKVQDFQEDKELFRYCTLPEILKYVECFTGPNIMAMHTMLINKPPDSGKKTSRHPLHQDLHYFPFRPSDLIVCAWTAMEHISRNNGCLVVLPGTHKGSLKPHDYPKWEGGVNKMFHGIQDYEENKARVHLVMEKGDTVFFHPLLIHGSGQNKTQGFRKAISCHFASADCHYIDVKGTSQENIEKEVVGIAHKFFGAENSVNLKDIWMFRARLVKGERTNL

SEQ ID NO: 63684 - protein, 238 aa, Homo sapiens
  Payload ID: 12703
  Gene Symbol: PHYH
  Gene Name: phytanoyl-CoA 2-hydroxylase
  Uniprot ID: O14832
  ENSP ID: ENSP00000380121
MRDVTISKSEYAPSEKMITKVQDFQEDKELFRYCTLPEILKYVECFTGPNIMAMHTMLINKPPDSGKKTSRHPLHQDLHYFPFRPSDLIVCAWTAMEHISRNNGCLVVLPGTHKGSLKPHDYPKWEGGVNKMFHGIQDYEENKARVHLVMEKGDTVFFHPLLIHGSGQNKTQGFRKAISCHFASADCHYIDVKGTSQENIEKEVVGIAHKFFGAENSVNLKDIWMFRARLVKGERTNL

SEQ ID NO: 63685 - protein, 321 aa, Homo sapiens
  Payload ID: 12703
  Gene Symbol: PHYH
  Gene Name: phytanoyl-CoA 2-hydroxylase
  ENSP ID: ENSP00000380126
MRCYVNIPHPTSGTISSASFHPQQFQYTLDNNVLTLEQRKFYEENGFLVIKNLVPDADIQRFRNEFEKICRKEVKPLGLTVMRDVTISKSEYAPSEKMITKVQDFQEDKELFRYCTLPEILKYVECFTGPNIMAMHTMLINKPPDSGNCKKTSRHPLHQDLHYFPFRPSDLIVCAWTAMEHISRNNGCLVVLPGTHKGSLKPHDYPKWEGGVNKMFHGIQDYEENKARVHLVMEKGDTVFFHPLLIHGSGQNKTQGFRKAISCHFASADCHYIDVKGTSQENIEKEVVGIAHKFFGAENSVNLKDIWMFRARLVKGERTNL

SEQ ID NO: 63686 - protein, 176 aa, Homo sapiens
  Payload ID: 12703
  Gene Symbol: PHYH
  Gene Name: phytanoyl-CoA 2-hydroxylase
  ENSP ID: ENSP00000412525
MRDVTISKSEYAPSEKMITKVQDFQEDKELFRYCTLPEILKYVECFTGPNIMAMHTMLINKPPDSGKKTSRHPLHQDLHYFPFRPSDLIVCAWTAMEHISRNNGCLVVLPGTHKGSLKPHDYPKWEGGVNKMFHGIQDYEENKARVHLVMEKGDTVFFHPLLIHGSGQNKTQGFRK

SEQ ID NO: 63687 - protein, 210 aa, Homo sapiens
  Payload ID: 12703
  Gene Symbol: PHYH
  Gene Name: phytanoyl-CoA 2-hydroxylase
  ENSP ID: ENSP00000420117
MEQLRAAARLQIVLGHLGRPSAGAVVAHPTSGTISSASFHPQQFQYTLDNNVLTLEQRKFYEENGFLVIKNLVPDADIQRFRNEFEKICRKEVKPLGLTVMRDVTISKSEYAPSEKMITKVQDFQEDKELFRYCTLPEILKYVECFTGPNIMAMHTMLINKPPDSGNCKKTSRHPLHQDLHYFPFRPSDLIVCAWTAMEHISRNNGCLVV

SEQ ID NO: 63688 - protein, 330 aa, Homo sapiens
  Payload ID: 12704
  Gene Symbol: PHYHIP
  Gene Name: phytanoyl-CoA 2-hydroxylase interacting protein
  Uniprot ID: Q92561
  ENSP ID: ENSP00000320017
MELLSTPHSIEINNITCDSFRISWAMEDSDLERVTHYFIDLNKKENKNSNKFKHRDVPTKLVAKAVPLPMTVRGHWFLSPRTEYSVAVQTAVKQSDGEYLVSGWSETVEFCTGDYAKEHLAQLQEKAEQIAGRMLRFSVFYRNHHKEYFQHARTHCGNMLQPYLKDNSGSHGSPTSGMLHGVFFSCNTEFNTGQPPQDSPYGRWRFQIPAQRLFNPSTNLYFADFYCMYTAYHYAILVLAPKGSLGDRFCRDRLPLLDIACNKFLTCSVEDGELVFRHAQDLILEIIYTEPVDLSLGTLGEISGHQLMSLSTADAKKDPSCKTCNISVGR

SEQ ID NO: 63689 - protein, 330 aa, Homo sapiens; identical to SEQ ID NO: 63688
  Payload ID: 12704
  Gene Symbol: PHYHIP
  Gene Name: phytanoyl-CoA 2-hydroxylase interacting protein
  Uniprot ID: Q92561
  ENSP ID: ENSP00000415491

SEQ ID NO: 63690 - protein, 248 aa, Homo sapiens
  Payload ID: 12704
  Gene Symbol: PHYHIP
  Gene Name: phytanoyl-CoA 2-hydroxylase interacting protein
  ENSP ID: ENSP00000430870
MGESPPWDVPTKLVAKAVPLPMTVRGHWFLSPRTEYSVAVQTAVKQSDGEYLVSGWSETVEFCTGDYAKEHLAQLQEKAEQIAGRMLRFSVFYRNHHKEYFQHARTHCGNMLQPYLKDNSGSHGSPTSGMLHGVFFSCNTEFNTGQPPQDSPYGRWRFQIPAQRLFNPSTNLYFADFYCMYTAYHYAILVLAPKGSLGDRFCRDRLPLLDIACNKFLTCSVEDGELVFRHAQDLILEIIYTEPVDLSL

SEQ ID NO: 63691 - protein, 350 aa, Homo sapiens
  Payload ID: 12705
  Gene Symbol: PHYHIPL
  Gene Name: phytanoyl-CoA 2-hydroxylase interacting protein-like
  Uniprot ID: Q96FC7
  ENSP ID: ENSP00000362985
MCCDSDFVARNKSQDSGIAEMEELPVPHNIKISNITCDSFKISWEMDSKSKDRITHYFIDLNKKENKNSNKFKHKDVPTKLVAKAVPLPMTVRGHWFLSPRTEYTVAVQTASKQVDGDYVVSEWSEIIEFCTADYSKVHLTQLLEKAEVIAGRMLKFSVFYRNQHKEYFDYVREHHGNAMQPSVKDNSGSHGSPISGKLEGIFFSCSTEFNTGKPPQDSPYGRYRFEIAAEKLFNPNTNLYFGDFYCMYTAYHYVILVIAPVGSPGDEFCKQRLPQLNSKDNKFLTCTEEDGVLVYHHAQDVILEVIYTDPVDLSVGTVAEITGHQLMSLSTANAKKDPSCKTCNISVGR

SEQ ID NO: 63692 - protein, 376 aa, Homo sapiens
  Payload ID: 12705
  Gene Symbol: PHYHIPL
  Gene Name: phytanoyl-CoA 2-hydroxylase interacting protein-like
  Uniprot ID: Q96FC7
  ENSP ID: ENSP00000362987
MEVPRLDHALNSPTSPCEEVIKNLSLEAIQLCDRDGNKSQDSGIAEMEELPVPHNIKISNITCDSFKISWEMDSKSKDRITHYFIDLNKKENKNSNKFKHKDVPTKLVAKAVPLPMTVRGHWFLSPRTEYTVAVQTASKQVDGDYVVSEWSEIIEFCTADYSKVHLTQLLEKAEVIAGRMLKFSVFYRNQHKEYFDYVREHHGNAMQPSVKDNSGSHGSPISGKLEGIFFSCSTEFNTGKPPQDSPYGRYRFEIAAEKLFNPNTNLYFGDFYCMYTAYHYVILVIAPVGSPGDEFCKQRLPQLNSKDNKFLTCTEEDGVLVYHHAQDVILEVIYTDPVDLSVGTVAEITGHQLMSLSTANAKKDPSCKTCNISVGR

SEQ ID NO: 63693 - protein, 49 aa, Homo sapiens
  Payload ID: 12705
  Gene Symbol: PHYHIPL
  Gene Name: phytanoyl-CoA 2-hydroxylase interacting protein-like
  Uniprot ID: Q96FC7
  ENSP ID: ENSP00000423634
MEVPRLDHALNSPTSPCEEVIKNLSLEAIQLCDRDVVFEELTSKQTRKG

SEQ ID NO: 63694 - protein, 297 aa, Homo sapiens
  Payload ID: 12706
  Gene Symbol: PHYHD1
  Gene Name: phytanoyl-CoA dioxygenase domain containing 1
  Uniprot ID: Q5SRE7
  ENSP ID: ENSP00000309515
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSINKIGHALHAHDPVFKSITHSFKVQTLARSLGLQMPVVVQSMYIFKSPLIRTPPSCTRSPWAGCWACGSQWRMPRWRTAVSGSSLAPTPVVCQEGWSGPLLAQRLVPASLGQSQPGITASLCPPQCREGPWSSSMEKWYTRASRTSLTARARPTLSTSWRPLAPPGARRTGSSQQLNCPFPNCTPKGSRRAGALAPPG

SEQ ID NO: 63695 - protein, 270 aa, Homo sapiens
  Payload ID: 12706
  Gene Symbol: PHYHD1
  Gene Name: phytanoyl-CoA dioxygenase domain containing 1
  Uniprot ID: Q5SRE7
  ENSP ID: ENSP00000340945
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSINKIGHALHAHDPVFKSITHSFKVQQPHFGGEVSPHQDASFLYTEPLGRVLGVWIAVEDATLENGCLWFIPGSHTSGVSRRMVRAPVGSAPGTSFLGSEPARDNSLFVPTPVQRGALVLIHGEVVHKSKQNLSDRSRQAYTFHLMEASGTTWSPENWLQPTAELPFPQLYT

SEQ ID NO: 63696 - protein, 291 aa, Homo sapiens
  Payload ID: 12706
  Gene Symbol: PHYHD1
  Gene Name: phytanoyl-CoA dioxygenase domain containing 1
  Uniprot ID: Q5SRE7
  ENSP ID: ENSP00000361673
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSINKIGHALHAHDPVFKSITHSFKVQTLARSLGLQMPVVVQSMYIFKQPHFGGEVSPHQDASFLYTEPLGRVLGVWIAVEDATLENGCLWFIPGSHTSGVSRRMVRAPVGSAPGTSFLGSEPARDNSLFVPTPVQRGALVLIHGEVVHKSKQNLSDRSRQAYTFHLMEASGTTWSPENWLQPTAELPFPQLYT

SEQ ID NO: 63697 - protein, 66 aa, Homo sapiens
  Payload ID: 12706
  Gene Symbol: PHYHD1
  Gene Name: phytanoyl-CoA dioxygenase domain containing 1
  ENSP ID: ENSP00000390568
MACLSPSQLQKFQQDGFLVLEGFLSAEECVAMQQRIGEIVAEMDVPLHCRTEFSTQEEEQLRAQGS

SEQ ID NO: 63698 - protein, 97 aa, Homo sapiens
  Payload ID: 12706
  Gene Symbol: PHYHD1
  Gene Name: phytanoyl-CoA dioxygenase domain containing 1
  ENSP ID: ENSP00000399438
SCSNLTLAVKSPLIRTPPSCTRSPWAGCWACGSQWRMPRWRTAVSGSSLAPTPGPWSSSMEKWYTRASRTSLTARARPTLSTSWRPLAPPGARRTGR

SEQ ID NO: 63699 - protein, 64 aa, Homo sapiens
  Payload ID: 12706
  Gene Symbol: PHYHD1
  Gene Name: phytanoyl-CoA dioxygenase domain containing 1
  ENSP ID: ENSP00000401016
MACLSPSQLQKFQQDGFLVLEGFLSAEECVAMQQRIGEIVAEMDVPLHCRTEFSTQEEEQLRAQ

SEQ ID NO: 63700 - protein, 160 aa, Homo sapiens
  Payload ID: 12706
  Gene Symbol: PHYHD1
  Gene Name: phytanoyl-CoA dioxygenase domain containing 1
  ENSP ID: ENSP00000401991
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSINKIGHALHAHDPVFKSITHSFKVQTLARSLGLQMPVVVQSMYIFKQPHFGGEGELRAVGP

SEQ ID NO: 63701 - protein, 164 aa, Homo sapiens
  Payload ID: 12706
  Gene Symbol: PHYHD1
  Gene Name: phytanoyl-CoA dioxygenase domain containing 1
  ENSP ID: ENSP00000407232
PPEKSINKIGHALHAHDPVFKSITHSFKVQTLARSLGLQMPVVVQSMYIFKSPLIRTPPSCTRSPWAGCWACGSQWRMPRWRTAVSGSSLAPTPGPWSSSMEKWYTRASRTSLTARARPTLSTSWRPLAPPGARRTGSSQQLNCPFPNCTPKGSRRAGALAPPG

SEQ ID NO: 63702 - protein, 270 aa, Homo sapiens; identical to SEQ ID NO: 63695
  Payload ID: 12706
  Gene Symbol: PHYHD1
  Gene Name: phytanoyl-CoA dioxygenase domain containing 1
  Uniprot ID: Q5SRE7
  ENSP ID: ENSP00000409928

SEQ ID NO: 63703 - protein, 46 aa, Homo sapiens
  Payload ID: 12706
  Gene Symbol: PHYHD1
  Gene Name: phytanoyl-CoA dioxygenase domain containing 1
  ENSP ID: ENSP00000412105
MACLSPSQLQKQPILIALCWVPDSMPGVGDRAANKIPGPTFTQLQG

SEQ ID NO: 63704 - protein, 177 aa, Homo sapiens
  Payload ID: 12706
  Gene Symbol: PHYHD1
  Gene Name: phytanoyl-CoA dioxygenase domain containing 1
  ENSP ID: ENSP00000412377
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSINKIGHALHAHDPVFKSITHSFKVQTLARSLGLQMPVVVQSMYIFKQPHFGGEVSPHQDASFLYTEPLGRVLGVWIAV

SEQ ID NO: 63705 - protein, 54 aa, Homo sapiens
  Payload ID: 12706
  Gene Symbol: PHYHD1
  Gene Name: phytanoyl-CoA dioxygenase domain containing 1
  ENSP ID: ENSP00000412738
  MOD_RES (1)..(1): Any amino acid
XDGFLVLEGFLSAEECVAMQQRIGEIVAEMDVPLHCRTEFSTQEEEQLRAQAQL

SEQ ID NO: 63706 - protein, 5142 aa, Homo sapiens
  Payload ID: 12707
  Gene Symbol: PCLO
  Gene Name: piccolo presynaptic cytomatrix protein
  Uniprot ID: Q9Y6V0
  ENSP ID: ENSP00000334319
MGNEASLEGEGLPEGLAAAAAAGGGASGAGSPSHTAIPAGMEADLSQLSEEERRQIAAVMSRAQGLPKGSVPPAAAESPSMHRKQELDSSHPPKQSGRPPDPGRPAQPGLSKSRTTDTFRSEQKLPGRSPSTISLKESKSRTDLKEEHKSSMMPGFLSEVNALSAVSSVVNKFNPFDLISDSEASQEETTKKQKVVQKEQGKPEGIIKPPLQQQPPKPIPKQQGPGRDPLQQDGTPKSISSQQPEKIKSQPPGTGKPIQGPTQTPQTDHAKLPLQRDASRPQTKQADIVRGESVKPSLPSPSKPPIQQPTPGKPPAQQPGHEKSQPGPAKPPAQPSGLTKPLAQQPGTVKPPVQPPGTTKPPAQPLGPAKPPAQQTGSEKPSSEQPGPKALAQPPGVGKTPAQQPGPAKPPTQQVGTPKPLAQQPGLQSPAKAPGPTKTPVQQPGPGKIPAQQAGPGKTSAQQTGPTKPPSQLPGPAKPPPQQPGPAKPPPQQPGSAKPPSQQPGSTKPPPQQPGPAKPSPQQPGSTKPPSQQPGSAKPSAQQPSPAKPSAQQSTKPVSQTGSGKPLQPPTVSPSAKQPPSQGLPKTICPLCNTTELLLHVPEKANFNTCTECQTTVCSLCGFNPNPHLTEVKEWLCLNCQMKRALGGDLAPVPSSPQPKLKTAPVTTTSAVSKSSPQPQQTSPKKDAAPKQDLSKAPEPKKPPPLVKQPTLHGSPSAKAKQPPEADSLSKPAPPKEPSVPSEQDKAPVADDKPKQPKMVKPTTDLVSSSSATTKPDIPSSKVQSQAEEKTTPPLKTDSAKPSQSFPPTGEKVSPFDSKAIPRPASDSKIISHPGPSSESKGQKQVDPVQKKEEPKKAQTKMSPKPDAKPMPKGSPTPPGPRPTAGQTVPTPQQSPKPQEQSRRFSLNLGSITDAPKSQPTTPQETVTGKLFGFGASIFSQASNLISTAGQPGPHSQSGPGAPMKQAPAPSQPPTSQGPPKSTGQAPPAPAKSIPVKKETKAPAAEKLEPKAEQAPTVKRTETEKKPPPIKDSKSLTAEPQKAVLPTKLEKSPKPESTCPLCKTELNIGSKDPPNFNTCTECKNQVCNLCGFNPTPHLTEIQEWLCLNCQTQRAISGQLGDIRKMPPAPSGPKASPMPVPTESSSQKTAVPPQVKLVKKQEQEVKTEAEKVILEKVKETLSMEKIPPMVTTDQKQEESKLEKDKASALQEKKPLPEEKKLIPEEEKIRSEEKKPLLEEKKPTPEDKKLLPEAKTSAPEEQKHDLLKSQVQIAEEKLEGRVAPKTVQEGKQPQTKMEGLPSGTPQSLPKEDDKTTKTIKEQPQPPCTAKPDQVEPGKEKTEKEDDKSDTSSSQQPKSPQGLSDTGYSSDGISSSLGEIPSLIPTDEKDILKGLKKDSFSQESSPSSPSDLAKLESTVLSILEAQASTLADEKSEKKTQPHEVSPEQPKDQEKTQSLSETLEITISEEEIKESQEERKDTFKKDSQQDIPSSKDHKEKSEFVDDITTRREPYDSVEESSESENSPVPQRKRRTSVGSSSSDEYKQEDSQGSGEEEDFIRKQIIEMSADEDASGSEDDEFIRNQLKEISSSTESQKKEETKGKGKITAGKHRRLTRKSSTSIDEDAGRRHSWHDEDDEAFDESPELKYRETKSQESEELVVTGGGGLRRFKTIELNSTIADKYSAESSQKKTSLYFDEEPELEMESLTDSPEDRSRGEGSSSLHASSFTPGTSPTSVSSLDEDSDSSPSHKKGESKQQRKARHRPHGPLLPTIEDSSEEEELREEEELLKEQEKQREIEQQQRKSSSKKSKKDKDELRAQRRRERPKTPPSNLSPIEDASPTEELRQAAEMEELHRSSCSEYSPSIESDPEGFEISPEKIIEVQKVYKLPTAVSLYSPTDEQSIMQKEGSQKALKSAEEMYEEMMHKTHKYKAFPAANERDEVFEKEPLYGGMLIEDYIYESLVEDTYNGSVDGSLLTRQEEENGFMQQKGREQKIRLSEQIYEDPMQKITDLQKEFYELESLHSVVPQEDIVSSSFIIPESHEIVDLGTMVTSTEEERKLLDADAAYEELMKRQQMQLTPGSSPTQAPIGEDMTESTMDFDRMPDASLTSSVLSGASLTDSTSSATLSIPDVKITQHFSTEEIEDEYVTDYTREIQEIIAHESLILTYSEPSESATSVPPSDTPSLTSSVSSVCTTDSSSPITTLDSITTVYTEPVDMITKFEDSEEISSSTYFPGSIIDYPEEISVSLDRTAPPDGRASADHIVISLSDMASSIIESVVPKPEGPVADTVSTDLLISEKDPVKKAKKETGNGIILEVLEAYRDKKELEAERTKSSLSETVFDHPPSSVIALPMKEQLSTTYFTSGETFGQEKPASQLPSGSPSVSSLPAKPRPFFRSSSLDISAQPPPPPPPPPPPPPPPPPPPPPPLPPPTSPKPTILPKKKLTVASPVTTATPLFDAVTTLETTAVLRSNGLPVTRICTTAPPPVPPKPSSIPSGLVFTHRPEPSKPPIAPKPVIPQLPTTTQKPTDIHPKPTGLSLTSSMTLNLVTSADYKLPSPTSPLSPHSNKSSPRFSKSLTETYVVITLPSEPGTPTDSSASQAITSWPLGSPSKDLVSVEPVFSVVPPVTAVEIPISSEQTFYISGALQTFSATPVTAPSSFQAAPTSVTQFLTTEVSKTEVSATRSTAPSVGLSSISITIPPEPLALDNIHLEKPQYKEDGKLQLVGDVIDLRTVPKVEVKTTDKCIDLSASTMDVKRQITANEVYGKQISAVQPSIINLSVTSSIVTPVSLATETVTFVTCTASASYTTGTESLVGAEHAMTTPLQLTTSKHAEPPYRIPSDQVFPIAREEAPINLSLGTPAHAVTLAITKPVTVPPVGVTNGWTDSTVSQGITDGEVVDLSTTKSHRTVVTMDESTSSVMTKIIEDEKPVDLTAGRRAVCCDVVYKLPFGRSCTAQQPATTLPEDRFGYRDDHYQYDRSGPYGYRGIGGMKPSMSDTNLAEAGHFFYKSKNAFDYSEGTDTAVDLTSGRVTTGEVMDYSSKTTGPYPETRQVISGAGISTPQYSTARMTPPPGPQYCVGSVLRSSNGVVYSSVATPTPSTFAITTQPGSIFSTTVRDLSGIHTADAVTSLPAMHHSQPMPRSYFITTGASETDIAVTGIDISASLQTITMESLTAETIDSVPTLTTASEVFPEVVGDESALLIVPEEDKQQQQLDLERELLELEKIKQQRFAEELEWERQEIQRFREQEKIMVQKKLEELQSMKQHLLFQQEEERQAQFMMRQETLAQQQLQLEQIQQLQQQLHQQLEEQKIRQIYQYNYDPSGTASPQTTTEQAILEGQYAALEGSQFWATEDATTTASAVVAIEIPQSQGWYTVQSDGVTQYIAPPGILSTVSEIPLTDVVVKEEKQPKKRSSGAKVRGQYDDMGENMTDDPRSFKKIVDSGVQTDDEDATDRSYVSRRRRTKKSVDTSVQTDDEDQDEWDMPTRSRRKARVGKYGDSMTEADKTKPLSKVSSIAVQTVAEISVQTEPVGTIRTPSIRARVDAKVEIIKHISAPEKTYKGGSLGCQTEADSDTQSPQYLSATSPPKDKKRPTPLEIGYSSHLRADSTVQLAPSPPKSPKVLYSPISPLSPGKALESAFVPYEKPLPDDISPQKVLHPDMAKVPPASPKTAKMMQRSMSDPKPLSPTADESSRAPFQYTEGYTTKGSQTMTSSGAQKKVKRTLPNPPPEEISTGTQSTFSTMGTVSRRRICRTNTMARAKILQDIDRELDLVERESAKLRKKQAELDEEEKEIDAKLRYLEMGINRRKEALLKEREKRERAYLQGVAEDRDYMSDSEVSSTRPTRIESQHGIERPRTAPQTEFSQFIPPQTQTESQLVPPTSPYTQYQYSSPALPTQAPTSYTQQSHFEQQTLYHQQVSPYQTQPTFQAVATMSFTPQVQPTPTPQPSYQLPSQMMVIQQKPRQTTLYLEPKITSNYEVIRNQPLMIAPVSTDNTFAVSHLGSKYNSLDLRIGLEERSSMASSPISSISADSFYADIDHHTPRNYVLIDDIGEITKGTAALSTAFSLHEKDLSKTDRLLRTTETRRSQEVTDFLAPLQSSSRLHSYVKAEEDPMEDPYELKLLKHQIKQEFRRGTESLDHLAGLSHYYHADTSYRHFPKSEKYSISRLTLEKQAAKQLPAAILYQKQSKHKKSLIDPKMSKFSPIQESRDLEPDYSSYMTSSTSSIGGISSRARLLQDDITFGLRKNITDQQKFMGSSLGTGLGTLGNTIRSALQDEADKPYSSGSRSRPSSRPSSVYGLDLSIKRDSSSSSLRLKAQEAEALDVSFSHASSSARTKPTSLPISQSRGRIPIVAQNSEEESPLSPVGQPMGMARAAAGPLPPISADTRDQFGSSHSLPEVQQHMREESRTRGYDRDIAFIMDDFQHAMSDSEAYHLRREETDWFDKPRESRLENGHGLDRKLPERLVHSRPLSQHQEQIIQMNGKTMHYIFPHARIKITRDSKDHTVSGNGLGIRIVGGKEIPGHSGEIGAYIAKILPGGSAEQTGKLMEGMQVLEWNGIPLTSKTYEEVQSIISQQSGEAEICVRLDLNMLSDSENSQHLELHEPPKAVDKAKSPGVDPKQLAAELQKVSLQQSPLVLSSVVEKGSHVHSGPTSAGSSSVPSPGQPGSPSVSKKKHGSSKPTDGTKVVSHPITGEIQLQINYDLGNLIIHILQARNLVPRDNNGYSDPFVKVYLLPGRGQVMVVQNASAEYKRRTKHVQKSLNPEWNQTVIYKSISMEQLKKKTLEVTVWDYDRFSSNDFLGEVLIDLSSTSHLDNTPRWYPLKEQTESIDHGKSHSSQSSQQSPKPSVIKSRSHGIFPDPSKDMQVPTIEKSHSSPGSSKSSSEGHLRSHGPSRSQSKTSVTQTHLEDAGAAIAAAEAAVQQLRIQPTKPPNHRPAESSVSTGSSGSSFGSGYSVDSEGSSSTAGETNLFPIPRIGKMGQNGQEPVKQPGVGVGLADTEAKTQVMGEIKIALKKEMKTDGEQLIVEILQCRNITYKFKSPDHLPDLYVKIYVMNISTQKKVIKKKTRVCRHDREPSFNETFRFSLSPAGHSLQILLFSNGGKFMKKTLIGEACIWLDKVDLRKRIVNWHKLLVSPTQTH

SEQ ID NO: 63707 - protein, 4935 aa, Homo sapiens
  Payload ID: 12707
  Gene Symbol: PCLO
  Gene Name: piccolo presynaptic cytomatrix protein
  Uniprot ID: Q9Y6V0
  ENSP ID: ENSP00000388393
MGNEASLEGEGLPEGLAAAAAAGGGASGAGSPSHTAIPAGMEADLSQLSEEERRQIAAVMSRAQGLPKGSVPPAAAESPSMHRKQELDSSHPPKQSGRPPDPGRPAQPGLSKSRTTDTFRSEQKLPGRSPSTISLKESKSRTDLKEEHKSSMMPGFLSEVNALSAVSSVVNKFNPFDLISDSEASQEETTKKQKVVQKEQGKPEGIIKPPLQQQPPKPIPKQQGPGRDPLQQDGTPKSISSQQPEKIKSQPPGTGKPIQGPTQTPQTDHAKLPLQRDASRPQTKQADIVRGESVKPSLPSPSKPPIQQPTPGKPPAQQPGHEKSQPGPAKPPAQPSGLTKPLAQQPGTVKPPVQPPGTTKPPAQPLGPAKPPAQQTGSEKPSSEQPGPKALAQPPGVGKTPAQQPGPAKPPTQQVGTPKPLAQQPGLQSPAKAPGPTKTPVQQPGPGKIPAQQAGPGKTSAQQTGPTKPPSQLPGPAKPPPQQPGPAKPPPQQPGSAKPPSQQPGSTKPPPQQPGPAKPSPQQPGSTKPPSQQPGSAKPSAQQPSPAKPSAQQSTKPVSQTGSGKPLQPPTVSPSAKQPPSQGLPKTICPLCNTTELLLHVPEKANFNTCTECQTTVCSLCGFNPNPHLTEVKEWLCLNCQMKRALGGDLAPVPSSPQPKLKTAPVTTTSAVSKSSPQPQQTSPKKDAAPKQDLSKAPEPKKPPPLVKQPTLHGSPSAKAKQPPEADSLSKPAPPKEPSVPSEQDKAPVADDKPKQPKMVKPTTDLVSSSSATTKPDIPSSKVQSQAEEKTTPPLKTDSAKPSQSFPPTGEKVSPFDSKAIPRPASDSKIISHPGPSSESKGQKQVDPVQKKEEPKKAQTKMSPKPDAKPMPKGSPTPPGPRPTAGQTVPTPQQSPKPQEQSRRFSLNLGSITDAPKSQPTTPQETVTGKLFGFGASIFSQASNLISTAGQPGPHSQSGPGAPMKQAPAPSQPPTSQGPPKSTGQAPPAPAKSIPVKKETKAPAAEKLEPKAEQAPTVKRTETEKKPPPIKDSKSLTAEPQKAVLPTKLEKSPKPESTCPLCKTELNIGSKDPPNFNTCTECKNQVCNLCGFNPTPHLTEIQEWLCLNCQTQRAISGQLGDIRKMPPAPSGPKASPMPVPTESSSQKTAVPPQVKLVKKQEQEVKTEAEKVILEKVKETLSMEKIPPMVTTDQKQEESKLEKDKASALQEKKPLPEEKKLIPEEEKIRSEEKKPLLEEKKPTPEDKKLLPEAKTSAPEEQKHDLLKSQVQIAEEKLEGRVAPKTVQEGKQPQTKMEGLPSGTPQSLPKEDDKTTKTIKEQPQPPCTAKPDQVEPGKEKTEKEDDKSDTSSSQQPKSPQGLSDTGYSSDGISSSLGEIPSLIPTDEKDILKGLKKDSFSQESSPSSPSDLAKLESTVLSILEAQASTLADEKSEKKTQPHEVSPEQPKDQEKTQSLSETLEITISEEEIKESQEERKDTFKKDSQQDIPSSKDHKEKSEFVDDITTRREPYDSVEESSESENSPVPQRKRRTSVGSSSSDEYKQEDSQGSGEEEDFIRKQIIEMSADEDASGSEDDEFIRNQLKEISSSTESQKKEETKGKGKITAGKHRRLTRKSSTSIDEDAGRRHSWHDEDDEAFDESPELKYRETKSQESEELVVTGGGGLRRFKTIELNSTIADKYSAESSQKKTSLYFDEEPELEMESLTDSPEDRSRGEGSSSLHASSFTPGTSPTSVSSLDEDSDSSPSHKKGESKQQRKARHRPHGPLLPTIEDSSEEEELREEEELLKEQEKQREIEQQQRKSSSKKSKKDKDELRAQRRRERPKTPPSNLSPIEDASPTEELRQAAEMEELHRSSCSEYSPSIESDPEGFEISPEKIIEVQKVYKLPTAVSLYSPTDEQSIMQKEGSQKALKSAEEMYEEMMHKTHKYKAFPAANERDEVFEKEPLYGGMLIEDYIYESLVEDTYNGSVDGSLLTRQEEENGFMQQKGREQKIRLSEQIYEDPMQKITDLQKEFYELESLHSVVPQEDIVSSSFIIPESHEIVDLGTMVTSTEEERKLLDADAAYEELMKRQQMQLTPGSSPTQAPIGEDMTESTMDFDRMPDASLTSSVLSGASLTDSTSSATLSIPDVKITQHFSTEEIEDEYVTDYTREIQEIIAHESLILTYSEPSESATSVPPSDTPSLTSSVSSVCTTDSSSPITTLDSITTVYTEPVDMITKFEDSEEISSSTYFPGSIIDYPEEISVSLDRTAPPDGRASADHIVISLSDMASSIIESVVPKPEGPVADTVSTDLLISEKDPVKKAKKETGNGIILEVLEAYRDKKELEAERTKSSLSETVFDHPPSSVIALPMKEQLSTTYFTSGETFGQEKPASQLPSGSPSVSSLPAKPRPFFRSSSLDISAQPPPPPPPPPPPPPPPPPPPPPPLPPPTSPKPTILPKKKLTVASPVTTATPLFDAVTTLETTAVLRSNGLPVTRICTTAPPPVPPKPSSIPSGLVFTHRPEPSKPPIAPKPVIPQLPTTTQKPTDIHPKPTGLSLTSSMTLNLVTSADYKLPSPTSPLSPHSNKSSPRFSKSLTETYVVITLPSEPGTPTDSSASQAITSWPLGSPSKDLVSVEPVFSVVPPVTAVEIPISSEQTFYISGALQTFSATPVTAPSSFQAAPTSVTQFLTTEVSKTEVSATRSTAPSVGLSSISITIPPEPLALDNIHLEKPQYKEDGKLQLVGDVIDLRTVPKVEVKTTDKCIDLSASTMDVKRQITANEVYGKQISAVQPSIINLSVTSSIVTPVSLATETVTFVTCTASASYTTGTESLVGAEHAMTTPLQLTTSKHAEPPYRIPSDQVFPIAREEAPINLSLGTPAHAVTLAITKPVTVPPVGVTNGWTDSTVSQGITDGEVVDLSTTKSHRTVVTMDESTSSVMTKIIEDEKPVDLTAGRRAVCCDVVYKLPFGRSCTAQQPATTLPEDRFGYRDDHYQYDRSGPYGYRGIGGMKPSMSDTNLAEAGHFFYKSKNAFDYSEGTDTAVDLTSGRVTTGEVMDYSSKTTGPYPETRQVISGAGISTPQYSTARMTPPPGPQYCVGSVLRSSNGVVYSSVATPTPSTFAITTQPGSIFSTTVRDLSGIHTADAVTSLPAMHHSQPMPRSYFITTGASETDIAVTGIDISASLQTITMESLTAETIDSVPTLTTASEVFPEVVGDESALLIVPEEDKQQQQLDLERELLELEKIKQQRFAEELEWERQEIQRFREQEKIMVQKKLEELQSMKQHLLFQQEEERQAQFMMRQETLAQQQLQLEQIQQLQQQLHQQLEEQKIRQIYQYNYDPSGTASPQTTTEQAILEGQYAALEGSQFWATEDATTTASAVVAIEIPQSQGWYTVQSDGVTQYIAPPGILSTVSEIPLTDVVVKEEKQPKKRSSGAKVRGQYDDMGENMTDDPRSFKKIVDSGVQTDDEDATDRSYVSRRRRTKKSVDTSVQTDDEDQDEWDMPTRSRRKARVGKYGDSMTEADKTKPLSKVSSIAVQTVAEISVQTEPVGTIRTPSIRARVDAKVEIIKHISAPEKTYKGGSLGCQTEADSDTQSPQYLSATSPPKDKKRPTPLEIGYSSHLRADSTVQLAPSPPKSPKVLYSPISPLSPGKALESAFVPYEKPLPDDISPQKVLHPDMAKVPPASPKTAKMMQRSMSDPKPLSPTADESSRAPFQYTEGYTTKGSQTMTSSGAQKKVKRTLPNPPPEEISTGTQSTFSTMGTVSRRRICRTNTMARAKILQDIDRELDLVERESAKLRKKQAELDEEEKEIDAKLRYLEMGINRRKEALLKEREKRERAYLQGVAEDRDYMSDSEVSSTRPTRIESQHGIERPRTAPQTEFSQFIPPQTQTESQLVPPTSPYTQYQYSSPALPTQAPTSYTQQSHFEQQTLYHQQVSPYQTQPTFQAVATMSFTPQVQPTPTPQPSYQLPSQMMVIQQKPRQTTLYLEPKITSNYEVIRNQPLMIAPVSTDNTFAVSHLGSKYNSLDLRIGLEERSSMASSPISSISADSFYADIDHHTPRNYVLIDDIGEITKGTAALSTAFSLHEKDLSKTDRLLRTTETRRSQEVTDFLAPLQSSSRLHSYVKAEEDPMEDPYELKLLKHQIKQEFRRGTESLDHLAGLSHYYHADTSYRHFPKSEKYSISRLTLEKQAAKQLPAAILYQKQSKHKKSLIDPKMSKFSPIQESRDLEPDYSSYMTSSTSSIGGISSRARLLQDDITFGLRKNITDQQKFMGSSLGTGLGTLGNTIRSALQDEADKPYSSGSRSRPSSRPSSVYGLDLSIKRDSSSSSLRLKAQEAEALDVSFSHASSSARTKPTSLPISQSRGRIPIVAQNSEEESPLSPVGQPMGMARAAAGPLPPISADTRDQFGSSHSLPEVQQHMREESRTRGYDRDIAFIMDDFQHAMSDSEAYHLRREETDWFDKPRESRLENGHGLDRKLPERLVHSRPLSQHQEQIIQMNGKTMHYIFPHARIKITRDSKDHTVSGNGLGIRIVGGKEIPGHSGEIGAYIAKILPGGSAEQTGKLMEGMQVLEWNGIPLTSKTYEEVQSIISQQSGEAEICVRLDLNMLSDSENSQHLELHEPPKAVDKAKSPGVDPKQLAAELQKVSLQQSPLVLSSVVEKGSHVHSGPTSAGSSSVPSPGQPGSPSVSKKKHGSSKPTDGTKVVSHPITGEIQLQINYDLGNLIIHILQARNLVPRDNNGYSDPFVKVYLLPGRGQVMVVQNASAEYKRRTKHVQKSLNPEWNQTVIYKSISMEQLKKKTLEVTVWDYDRFSSNDFLGEVLIDLSSTSHLDNTPRWYPLKEQTESIDHGKSHSSQSSQQSPKPSVIKSRSHGIFPDPSKDMQVPTIEKSHSSPGSSKSSSEGHLRSHGPSRSQSKTSVTQTHLEDAGAAIAAAEAAVQQLRIQPSKRRK

SEQ ID NO: 63708 - protein, 1217 aa, Homo sapiens
  Payload ID: 12707
  Gene Symbol: PCLO
  Gene Name: piccolo presynaptic cytomatrix protein
  ENSP ID: ENSP00000393760
MRQETLAQQQLQLEQIQQLQQQLHQQLEEQKIRQIYQYNYDPSGTASPQTTTEQAILEGQYAALEGSQFWATEDATTTASAVVAIEIPQSQGWYTVQSDGVTQYIAPPGILSTVSEIPLTDVVVKEEKQPKKRSSGAKVRGQYDDMGENMTDDPRSFKKIVDSGVQTDDEDATDRSYVSRRRRTKKSVDTSVQTDDEDQDEWDMPTRSRRKARVGKYGDSMTEADKTKPLSKVSSIAVQTVAEISVQTEPVGTIRTPSIRARVDAKVEIIKHISAPEKTYKGGSLGCQTEADSDTQSPQYLSATSPPKDKKRPTPLEIGYSSHLRADSTVQLAPSPPKSPKVLYSPISPLSPGKALESAFVPYEKPLPDDISPQKVLHPDMAKVPPASPKTAKMMQRSMSDPKPLSPTADESSRAPFQYTEGYTTKGSQTMTSSGAQKKVKRTLPNPPPEEISTGTQSTFSTMGTVSRRRICRTNTMARAKILQDIDRELDLVERESAKLRKKQAELDEEEKEIDAKLRYLEMGINRRKEALLKEREKRERAYLQGVAEDRDYMSDSEVSSTRPTRIESQHGIERPRTAPQTEFSQFIPPQTQTESQLVPPTSPYTQYQYSSPALPTQAPTSYTQQSHFEQQTLYHQQVSPYQTQPTFQAVATMSFTPQVQPTPTPQPSYQLPSQMMVIQQKPRQTTLYLEPKITSNYEVIRNQPLMIAPVSTDNTFAVSHLGSKYNSLDLRIGLEERSSMASSPISSISADSFYADIDHHTPRNYVLIDDIGEITKGTAALSTAFSLHEKDLSKTDRLLRTTETRRSQEVTDFLAPLQSSSRLHSYVKAEEDPMEDPYELKLLKHQIKQEFRRGTESLDHLAGLSHYYHADTSYRHFPKSEKYSISRLTLEKQAAKQLPAAILYQKQSKHKKSLIDPKMSKFSPIQESRDLEPDYSSYMTSSTSSIGGISSRARLLQDDITFGLRKNITDQQKFMGSSLGTGLGTLGNTIRSALQDEADKPYSSGSRSRPSSRPSSVYGLDLSIKRDSSSSSLRLKAQEAEALDVSFSHASSSARTKPTSLPISQSRGRIPIVAQNSEEESPLSPVGQPMGMARAAAGPLPPISADTRDQFGSSHSLPEVQQHMREESRTRGYDRDIAFIMDDFQHAMSDSEGKLGLKLPCYSQNSNSYFSACLISLLQRCILLFLVCLLHVYFNFISCKWKFYHVYRFCSMLFFI

SEQ ID NO: 63709 - protein, 60 aa, Homo sapiens
  Payload ID: 12707
  Gene Symbol: PCLO
  Gene Name: piccolo presynaptic cytomatrix protein
  ENSP ID: ENSP00000397928
  MOD_RES (1)..(1): Any amino acid
XNGLGIRIVGGKEIPGHSGEIGAYIAKILPGGSAEQTGKLMEDGMAVIKVGDQETQHTDE

SEQ ID NO: 63710 - protein, 46 aa, Homo sapiens
  Payload ID: 12707
  Gene Symbol: PCLO
  Gene Name: piccolo presynaptic cytomatrix protein
  ENSP ID: ENSP00000404191
  MOD_RES (1)..(1): Any amino acid
XNGLGIRIVGGKEIPGHSGEIGAYIAKILPGGSAEQTGKLMEAWDC

SEQ ID NO: 63711 - protein, 356 aa, Homo sapiens
  Payload ID: 12707
  Gene Symbol: PCLO
  Gene Name: piccolo presynaptic cytomatrix protein
  Uniprot ID: Q9Y6V0
  ENSP ID: ENSP00000482390
MKKFRVSLVSKVGKQKYVDLNMLSDSENSQHLELHEPPKAVDKAKSPGVDPKQLAAELQKVSLQQSPLVLSSVVEKGSHVHSGPTSAGSSSVPSPGQPGSPSVSKKKHGSSKPTDGTKVVSHPITGEIQLQINYDLGNLIIHILQARNLVPRDNNGYSDPFVKVYLLPGRGAEYKRRTKHVQKSLNPEWNQTVIYKSISMEQLKKKTLEVTVWDYDRFSSNDFLGEVLIDLSSTSHLDNTPRWYPLKEQTESIDHGKSHSSQSSQQSPKPSVIKSRSHGIFPDPSKDMQVPTIEKSHSSPGSSKSSSEGHLRSHGPSRSQSKTSVTQTHLEDAGAAIAAAEAAVQQLRIQPSKRRK

SEQ ID NO: 63712 - protein, 2521 aa, Homo sapiens
  Payload ID: 12708
  Gene Symbol: PIEZO1
  Gene Name: piezo-type mechanosensitive ion channel component 1
  Uniprot ID: Q92508
  ENSP ID: ENSP00000301015
MEPHVLGAVLYWLLLPCALLAACLLRFSGLSLVYLLFLLLLPWFPGPTRCGLQGHTGRLLRALLGLSLLFLVAHLALQICLHIVPRLDQLLGPSCSRWETLSRHIGVTRLDLKDIPNAIRLVAPDLGILVVSSVCLGICGRLARNTRQSPHPRELDDDERDVDASPTAGLQEAATLAPTRRSRLAARFRVTAHWLLVAAGRVLAVTLLALAGIAHPSALSSVYLLLFLALCTWWACHFPISTRGFSRLCVAVGCFGAGHLICLYCYQMPLAQALLPPAGIWARVLGLKDFVGPTNCSSPHALVLNTGLDWPVYASPGVLLLLCYATASLRKLRAYRPSGQRKEAAKGYEARELELAELDQWPQERESDQHVVPTAPDTEADNCIVHELTGQSSVLRRPVRPKRAEPREASPLHSLGHLIMDQSYVCALIAMMVWSITYHSWLTFVLLLWACLIWTVRSRHQLAMLCSPCILLYGMTLCCLRYVWAMDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSGLGAEEPLSSMTDDMGSPLSTGYHTRSGSEEAVTDPGEREAGASLYQGLMRTASELLLDRRLRIPELEEAELFAEGQGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 63713 - protein, 373 aa, Homo sapiens
  Payload ID: 12708
  Gene Symbol: PIEZO1
  Gene Name: piezo-type mechanosensitive ion channel component 1
  ENSP ID: ENSP00000333704
MKICPFSSKSSIVLALKFRSLIHFEKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKHHGAVRVHRAGHRQVRARILQRDLALHYVRGAAVRGPHPQALPGHLPGAGDSGAGAGGGVVRQAHLPLPLTGDHDQVDS

SEQ ID NO: 63714 - protein, 88 aa, Homo sapiens
  Payload ID: 12708
  Gene Symbol: PIEZO1
  Gene Name: piezo-type mechanosensitive ion channel component 1
  ENSP ID: ENSP00000406358
YQIRCGYPTRILGNFLTKKYNHLNLFLFQGFRLVPFLVELRAVMDWVWTDTTLSLSSWMCVEDIYANIFIIKCSRETEKVHEDLPVFF

SEQ ID NO: 63715 - protein, 181 aa, Homo sapiens
  Payload ID: 12708
  Gene Symbol: PIEZO1
  Gene Name: piezo-type mechanosensitive ion channel component 1
  ENSP ID: ENSP00000428673
  MOD_RES (1)..(1): Any amino acid
XSHYYLHVRADLQATALLASRGFALYNAANLKSIDFHRRIEEKSLAQLKRQMERIRAKQEKHRQGRVDRSRPQDTLGPKDPGLEPVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRV

SEQ ID NO: 63716 - protein, 184 aa, Homo sapiens
  Payload ID: 12708
  Gene Symbol: PIEZO1
  Gene Name: piezo-type mechanosensitive ion channel component 1
  ENSP ID: ENSP00000456373
  MOD_RES (1)..(1): Any amino acid
XSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKIHWLEMTELEEFSVFSGC

SEQ ID NO: 63717 - protein, 35 aa, Homo sapiens
  Payload ID: 12708
  Gene Symbol: PIEZO1
  Gene Name: piezo-type mechanosensitive ion channel component 1
  ENSP ID: ENSP00000456680
  MOD_RES (1)..(1): Any amino acid
XVIPNLFPKYIRAPNGPEANPVKQLQPNEEADYLG

SEQ ID NO: 63718 - protein, 2689 aa, Homo sapiens
  Payload ID: 12709
  Gene Symbol: PIEZO2
  Gene Name: piezo-type mechanosensitive ion channel component 2
  Uniprot ID: Q9H5I5
  ENSP ID: ENSP00000303316
MASEVVCGLIFRLLLPICLAVACAFRYNGLSFVYLIYLLLIPLFSEPTKTTMQGHTGRLLKSLCFISLSFLLLHIIFHITLVSLEAQHRIAPGYNCSTWEKTFRQIGFESLKGADAGNGIRVFVPDIGMFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPSDESSEKREEEEEEKEEFEEERSREEKRSIKVHAMVSVFQFIMKQSYICALIAMMAWSITYHSWLTFVLLIWSCTLWMIRNRRKYAMISSPFMVVYGNLLLILQYIWSFELPEIKKVPGFLEKKEPGELASKILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYRLAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNPVPDFIHCRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMPAANSPCTLPSGEAGIIWDSICFAFLLLQRRVFMSYYFLHVVADIKASQILASRGAELFQATIVKAVKARIEEEKKSMDQLKRQMDRIKARQQKYKKGKERMLSLTQEPGEGQDMQKLSEEDDEREADKQKAKGKKKQWWRPWVDHASMVRSGDYYLFETDSEEEEEEELKKEDEEPPRRSAFQFVYQAWITDPKTALRQRHKEKKRSAREERKRRRKGSKEGPVEWEDREDEPIKKKSDGPDNIIKRIFNILKFTWVLFLATVDSFTTWLNSISREHIDISTVLRIERCMLTREIKKGNVPTRESIHMYYQNHIMNLSRESGLDTIDEHPGAASGAQTAHRMDSLDSHDSISSEPTQCTMLYSRQGTTETIEEVEAEQEEEAGSTAPEPREAKEYEATGYDVGAMGAEEASLTPEEELTQFSTLDGDVEAPPSYSKAVSFEHLSFGSQDDSAGKNRMAVSPDDSRTDKLGSSILPPLTHELTASELLLKKMFHDDELEESEKFYVGQPRFLLLFYAMYNTLVARSEMVCYFVIILNHMVSASMITLLLPILIFLWAMLSVPRPSRRFWMMAIVYTEVAIVVKYFFQFGFFPWNKNVEVNKDKPYHPPNIIGVEKKEGYVLYDLIQLLALFFHRSILKCHGLWDEDDMTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 63719 - protein, 2703 aa, Homo sapiens
  Payload ID: 12709
  Gene Symbol: PIEZO2
  Gene Name: piezo-type mechanosensitive ion channel component 2
  ENSP ID: ENSP00000372900
MQGHTGRLLKSLCFISLSFLLLHIIFHITLVSLEAQHRIAPGYNCSTWEKTFRQIGFESLKGADAGNGIRVFVPDIGMFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPSDESSEKREEEEEEKEEFEEERSREEKRSIKVHAMVSVFQFIMKQSYICALIAMMAWSITYHSWLTFVLLIWSCTLWMIRNRRKYAMISSPFMVVYGNLLLILQYIWSFELPEIKKVPGFLEKKEPGELASKILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYRLAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEARVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNPVPDFIHCRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMPAANSPCTLPSGEAGIIWDSICFAFLLLQRRVFMSYYFLHVVADIKASQILASRGAELFQATIVKAVKARIEEEKKSMDQLKRQMDRIKARQQKYKKGKERMLSLTQEPGEGQDMQKLSEEDDEREADKQKAKGKKKQWWRPWVDHASMVRSGDYYLFETDSEEEEEEELKKEDEEPPRRSAFQFVYQAWITDPKTALRQRHKEKKRSAREERKRRRKGSKEGPVEWEDREDEPIKKKSDGPDNIIKRIFNILKFTWVLFLATVDSFTTWLNSISREHIDISTVLRIERCMLTREIKKGNVPTRESIHMYYQNHIMNLSRESGLDTIDEHPGAASGAQTAHRMDSLDSHDSISSEPTQCTMLYSRQGTTETIEEVEAEQEEEAGSTAPEPREAKEYEATGYDVGAMGAEEASLTPEEELTQFSTLDGDVEAPPSYSKAVSFEHLSFGSQDDSAGKNRMAVSPDDSRTDKLGSSILPPLTHELTASELLLKKMFHDDELEESEKFYVGQPRFLLLFYAMYNTLVARSEMVCYFVIILNHMVSASMITLLLPILIFLWAMLSVPRPSRRFWMMAIVYTEVAIVVKYFFQFGFFPWNKNVEVNKDKPYHPPNIIGVEKKEGYVLYDLIQLLALFFHRSILKCHGLWDEDDMTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKRYPQPRGQKKKKVVKYGMGGMIIVLLICIVWFPLLFMSLIKSVAGVINQPLDVSVTITLGGYQPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 63720 - protein, 2752 aa, Homo sapiens
  Payload ID: 12709
  Gene Symbol: PIEZO2
  Gene Name: piezo-type mechanosensitive ion channel component 2
  Uniprot ID: Q9H5I5
  ENSP ID: ENSP00000421377
MASEVVCGLIFRLLLPICLAVACAFRYNGLSFVYLIYLLLIPLFSEPTKTTMQGHTGRLLKSLCFISLSFLLLHIIFHITLVSLEAQHRIAPGYNCSTWEKTFRQIGFESLKGADAGNGIRVFVPDIGMFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPSDESSEKREEEEEEKEEFEEERSREEKRSIKVHAMVSVFQFIMKQSYICALIAMMAWSITYHSWLTFVLLIWSCTLWMIRNRRKYAMISSPFMVVYGNLLLILQYIWSFELPEIKKVPGFLEKKEPGELASKILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYRLAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNPVPDFIHCRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMPAANSPCTLPSGEAGIIWDSICFAFLLLQRRVFMSYYFLHVVADIKASQILASRGAELFQATIVKAVKARIEEEKKSMDQLKRQMDRIKARQQKYKKGKERMLSLTQEPGEGQDMQKLSEEDDEREADKQKAKGKKKQWWRPWVDHASMVRSGDYYLFETDSEEEEEEELKKEDEEPPRRSAFQFVYQAWITDPKTALRQRHKEKKRSAREERKRRRKGSKEGPVEWEDREDEPIKKKSDGPDNIIKRIFNILKFTWVLFLATVDSFTTWLNSISREHIDISTVLRIERCMLTREIKKGNVPTRESIHMYYQNHIMNLSRESGLDTIDEHPGAASGAQTAHRMDSLDSHDSISSEPTQCTMLYSRQGTTETIEEVEAEQEEEAGSTAPEPREAKEYEATGYDVGAMGAEEASLTPEEELTQFSTLDGDVEAPPSYSKAVSFEHLSFGSQDDSAGKNRMAVSPDDSRTDKLGSSILPPLTHELTASELLLKKMFHDDELEESEKFYVGQPRFLLLFYAMYNTLVARSEMVCYFVIILNHMVSASMITLLLPILIFLWAMLSVPRPSRRFWMMAIVYTEVAIVVKYFFQFGFFPWNKNVEVNKDKPYHPPNIIGVEKKEGYVLYDLIQLLALFFHRSILKCHGLWDEDDMTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKRYPQPRGQKKKKVVKYGMGGMIIVLLICIVWFPLLFMSLIKSVAGVINQPLDVSVTITLGGYQPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 63721 - protein, 709 aa, Homo sapiens
  Payload ID: 12709
  Gene Symbol: PIEZO2
  Gene Name: piezo-type mechanosensitive ion channel component 2
  Uniprot ID: Q9H5I5
  ENSP ID: ENSP00000443129
MTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKRYPQPRGQKKKKVVKYGMGGMIIVLLICIVWFPLLFMSLIKSVAGVINQPLDVSVTITLGGYQPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 63722 - protein, 1473 aa, Homo sapiens
  Payload ID: 12709
  Gene Symbol: PIEZO2
  Gene Name: piezo-type mechanosensitive ion channel component 2
  ENSP ID: ENSP00000462115
MASEVVCGLIFRLLLPICLAVACAFRYNGLSFVYLIYLLLIPLFSEPTKTTMQGHTGRLLKSLCFISLSFLLLHIIFHITLVSLEAQHRIAPGYNCSTWEKTFRQIGFESLKGADAGNGIRVFVPDIGMFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPSDESSEKREEEEEEKEEFEEERSREEKRSIKVHAMVSVFQFIMKQSYICALIAMMAWSITYHSWLTFVLLIWSCTLWMIRNRRKYAMISSPFMVVYGNLLLILQYIWSFELPEIKKVPGFLEKKEPGELASKILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYSHAKVNGRVYLIINRLAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNPVPDFIHCRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMPAANSPCTLPSGEAGIIWDSICFAFLLLQRRVFMSYYFLHVVADIKASQILASRWLNFSRPQL

SEQ ID NO: 63723 - protein, 92 aa, Homo sapiens
  Payload ID: 12709
  Gene Symbol: PIEZO2
  Gene Name: piezo-type mechanosensitive ion channel component 2
  ENSP ID: ENSP00000462187
WWSSMTKSVPQVWGSWLAMAFRLHVRPCPDVHPDPQHGRGLVVHWQSPSDLPSQDVLWRIFKGNLPVAASPCLQFENGLEPLAQDSGYLACP

SEQ ID NO: 63724 - protein, 192 aa, Homo sapiens
  Payload ID: 12709
  Gene Symbol: PIEZO2
  Gene Name: piezo-type mechanosensitive ion channel component 2
  ENSP ID: ENSP00000462560
MKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYRLAHPEGSLPDLTMMHLTASLEKPEVRKLAEPG

SEQ ID NO: 63725 - protein, 2777 aa, Homo sapiens
  Payload ID: 12709
  Gene Symbol: PIEZO2
  Gene Name: piezo-type mechanosensitive ion channel component 2
  Uniprot ID: Q9H5I5
  ENSP ID: ENSP00000463094
MASEVVCGLIFRLLLPICLAVACAFRYNGLSFVYLIYLLLIPLFSEPTKTTMQGHTGRLLKSLCFISLSFLLLHIIFHITLVSLEAQHRIAPGYNCSTWEKTFRQIGFESLKGADAGNGIRVFVPDIGMFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPSDESSEKREEEEEEKEEFEEERSREEKRSIKVHAMVSVFQFIMKQSYICALIAMMAWSITYHSWLTFVLLIWSCTLWMIRNRRKYAMISSPFMVVYGNLLLILQYIWSFELPEIKKVPGFLEKKEPGELASKILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYSHAKVNGRVYLIINSIKKKLPIHQNELAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNPVPDFIHCRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMPAANSPCTLPSGEAGIIWDSICFAFLLLQRRVFMSYYFLHVVADIKASQILASRGAELFQATIVKAVKARIEEEKKSMDQLKRQMDRIKARQQKYKKGKERMLSLTQEPGEGQDMQKLSEEDDEREADKQKAKGKKKQWWRPWVDHASMVRSGDYYLFETDSEEEEEEELKKEDEEPPRRSAFQFVYQAWITDPKTALRQRHKEKKRSAREERKRRRKGSKEGPVEWEDREDEPIKKKSDGPDNIIKRIFNILKFTWVLFLATVDSFTTWLNSISREHIDISTVLRIERCMLTREIKKGNVPTRESIHMYYQNHIMNLSRESGLDTIDEHPGAASGAQTAHRMDSLDSHDSISSEPTQCTMLYSRQGTTETIEEVEAEQEEEAGSTAPEPREAKEYEATGYDVGAMGAEEASLTPEEELTQFSTLDGDVEAPPSYSKAVSFEHLSFGSQDDSAGKNRMAVSPDDSRTDKLGSSILPPLTHELTASELLLKKMFHDDELEESEKFYVGQPRFLLLFYAMYNTLVARSEMVCYFVIILNHMVSASMITLLLPILIFLWAMLSVPRPSRRFWMMAIVYTEVAIVVKYFFQFGFFPWNKNVEVNKDKPYHPPNIIGVEKKEGYVLYDLIQLLALFFHRSILKCHGLWDEDDMTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKRYPQPRGQKKKKVVKYGMGGMIIVLLICIVWFPLLFMSLIKSVAGVINQPLDVSVTITLGGYQPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 63726 - protein, 178 aa, Homo sapiens
  Payload ID: 12709
  Gene Symbol: PIEZO2
  Gene Name: piezo-type mechanosensitive ion channel component 2
  ENSP ID: ENSP00000463589
  MOD_RES (1)..(1): Any amino acid
XTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKGLLVTVNGNPVDYHTIHPSLPMENGPGKADLYSTPQYRWEPSDESSEKREEEEEE

SEQ ID NO: 63727 - protein, 153 aa, Homo sapiens
  Payload ID: 12709
  Gene Symbol: PIEZO2
  Gene Name: piezo-type mechanosensitive ion channel component 2
  ENSP ID: ENSP00000477311
  MOD_RES (1)..(1): Any amino acid
XIKASQILASRGAELFQATIVKAVKARIEEEKKSMDQLKRQMDRIKARQQKYKKGKERMLSLTQEPGEGQDMQKLSEEDDEREADKQKAKGKKKQWWRPWVDHASSRFSRSPYNLIDSNPYILDQNSGVPVTHVFHAWFDPCDLIGGRSVGKF

SEQ ID NO: 63728 - protein, 641 aa, Homo sapiens
  Payload ID: 12710
  Gene Symbol: PIF1
  Gene Name: PIF1 5'-to-3' DNA helicase
  Uniprot ID: Q9H611
  ENSP ID: ENSP00000268043
MLSGIEAAAGEYEDSELRCRVAVEELSPGGQPRRRQALRTAELSLGRNERRELMLRLQAPGPAGRPRCFPLRAARLFTRFAEAGRSTLRLPAHDTPGAGAVQLLLSDCPPDRLRRFLRTLRLKLAAAPGPGPASARAQLLGPRPRDFVTISPVQPEERRLRAATRVPDTTLVKRPVEPQAGAEPSTEAPRWPLPVKRLSLPSTKPQLSEEQAAVLRAVLKGQSIFFTGSAGTGKSYLLKRILGSLPPTGTVATASTGVAACHIGGTTLHAFAGIGSGQAPLAQCVALAQRPGVRQGWLNCQRLVIDEISMVEADLFDKLEAVARAVRQQNKPFGGIQLIICGDFLQLPPVTKGSQPPRFCFQSKSWKRCVPVTLELTKVWRQADQTFISLLQAVRLGRCSDEVTRQLQATASHKVGRDGIVATRLCTHQDDVALTNERRLQELPGKVHRFEAMDSNPELASTLDAQCPVSQLLQLKLGAQVMLVKNLSVSRGLVNGARGVVVGFEAEGRGLPQVRFLCGVTEVIHADRWTVQATGGQLLSRQQLPLQLAWAMSIHKSQGMTLDCVEISLGRVFASGQAYVALSRARSLQGLRVLDFDPMAVRCDPRVLHFYATLRRGRSLSLESPDDDEAASDQENMDPIL

SEQ ID NO: 63729 - protein, 707 aa, Homo sapiens
  Payload ID: 12710
  Gene Symbol: PIF1
  Gene Name: PIF1 5'-to-3' DNA helicase
  Uniprot ID: Q9H611
  ENSP ID: ENSP00000328174
MLSGIEAAAGEYEDSELRCRVAVEELSPGGQPRRRQALRTAELSLGRNERRELMLRLQAPGPAGRPRCFPLRAARLFTRFAEAGRSTLRLPAHDTPGAGAVQLLLSDCPPDRLRRFLRTLRLKLAAAPGPGPASARAQLLGPRPRDFVTISPVQPEERRLRAATRVPDTTLVKRPVEPQAGAEPSTEAPRWPLPVKRLSLPSTKPQLSEEQAAVLRAVLKGQSIFFTGSAGTGKSYLLKRILGSLPPTGTVATASTGVAACHIGGTTLHAFAGIGSGQAPLAQCVALAQRPGVRQGWLNCQRLVIDEISMVEADLFDKLEAVARAVRQQNKPFGGIQLIICGDFLQLPPVTKGSQPPRFCFQSKSWKRCVPVTLELTKVWRQADQTFISLLQAVRLGRCSDEVTRQLQATASHKVGRDGIVATRLCTHQDDVALTNERRLQELPGKVHRFEAMDSNPELASTLDAQCPVSQLLQLKLGAQVMLVKNLSVSRGLVNGARGVVVGFEAEGRGLPQVRFLCGVTEVIHADRWTVQATGGQLLSRQQLPLQLAWAMSIHKSQGMTLDCVEISLGRVFASGQAYVALSRARSLQGLRVLDFDPMAVRCDPRVLHFYATLRRGRSLSLAAEGRGNEDRCSGSSIRALGGDWWGLRLGAASKQRTELRCVSTARPSLAQPRTNTLQSLTKEHKLQNVHPYFKLLFQGINSVWGH

SEQ ID NO: 63730 - protein, 641 aa, Homo sapiens; identical to SEQ ID NO: 63728
  Payload ID: 12710
  Gene Symbol: PIF1
  Gene Name: PIF1 5'-to-3' DNA helicase
  Uniprot ID: Q9H611
  ENSP ID: ENSP00000452792

SEQ ID NO: 63731 - protein, 29 aa, Homo sapiens
  Payload ID: 12711
  Gene Symbol: PIGBOS1
  Gene Name: PIGB opposite strand 1
  ENSP ID: ENSP00000481097
MFRRLTFAQLLFATVLGIAGGVYIFQPVF

SEQ ID NO: 63732 - protein, 54 aa, Homo sapiens
  Payload ID: 12711
  Gene Symbol: PIGBOS1
  Gene Name: PIGB opposite strand 1
  Uniprot ID: A0A0B4J2F0
  ENSP ID: ENSP00000482636
MFRRLTFAQLLFATVLGIAGGVYIFQPVFEQYAKDQKELKEKMQLVQESEEKKS

SEQ ID NO: 63733 - protein, 54 aa, Homo sapiens; identical to SEQ ID NO: 63732
  Payload ID: 12711
  Gene Symbol: PIGBOS1
  Gene Name: PIGB opposite strand 1
  Uniprot ID: A0A0B4J2F0
  ENSP ID: ENSP00000484893

SEQ ID NO: 63734 - protein, 809 aa, Homo sapiens
  Payload ID: 12712
  Gene Symbol: PGBD1
  Gene Name: piggyBac transposable element derived 1
  Uniprot ID: Q96JS3
  ENSP ID: ENSP00000259883
MYEALPGPAPENEDGLVKVKEEDPTWEQVCNSQEGSSHTQEICRLRFRHFCYQEAHGPQEALAQLRELCHQWLRPEMHTKEQIMELLVLEQFLTILPKELQPCVKTYPLESGEEAVTVLENLETGSGDTGQQASVYIQGQDMHPMVAEYQGVSLECQSLQLLPGITTLKCEPPQRPQGNPQEVSGPVPHGSAHLQEKNPRDKAVVPVFNPVRSQTLVKTEEETAQAVAAEKWSHLSLTRRNLCGNSAQETVMSLSPMTEEIVTKDRLFKAKQETSEEMEQSGEASGKPNRECAPQIPCSTPIATERTVAHLNTLKDRHPGDLWARMHISSLEYAAGDITRKGRKKDKARVSELLQGLSFSGDSDVEKDNEPEIQPAQKKLKVSCFPEKSWTKRDIKPNFPSWSALDSGLLNLKSEKLNPVELFELFFDDETFNLIVNETNNYASQKNVSLEVTVQEMRCVFGVLLLSGFMRHPRREMYWEVSDTDQNLVRDAIRRDRFELIFSNLHFADNGHLDQKDKFTKLRPLIKQMNKNFLLYAPLEEYYCFDKSMCECFDSDQFLNGKPIRIGYKIWCGTTTQGYLVWFEPYQEESTMKVDEDPDLGLGGNLVMNFADVLLERGQYPYHLCFDSFFTSVKLLSALKKKGVRATGTIRENRTEKCPLMNVEHMKKMKRGYFDFRIEENNEIILCRWYGDGIISLCSNAVGIEPVNEVSCCDADNEEIPQISQPSIVKVYDECKEGVAKMDQIISKYRVRIRSKKWYSILVSYMIDVAMNNAWQLHRACNPGASLDPLDFRRFVAHFYLEHNAHLSD

SEQ ID NO: 63735 - protein, 592 aa, Homo sapiens
  Payload ID: 12713
  Gene Symbol: PGBD2
  Gene Name: piggyBac transposable element derived 2
  Uniprot ID: Q6P3X8
  ENSP ID: ENSP00000331643
MASTSRDVIAGRGIHSKVKSAKLLEVLNAMEEEESNNNREEIFIAPPDNAAGEFTDEDSGDEDSQRGAHLPGSVLHASVLCEDSGTGEDNDDLELQPAKKRQKAVVKPQRIWTKRDIRPDFGSWTASDPHIEDLKSQELSPVGLFELFFDEGTINFIVNETNRYAWQKNVNLSLTAQELKCVLGILILSGYISYPRRRMFWETSPDSHHHLVADAIRRDRFELIFSYLHFADNNELDASDRFAKVRPLIIRMNCNFQKHAPLEEFYSFGESMCEYFGHRGSKQLHRGKPVRLGYKIWCGTTSRGYLVWFEPSQGTLFTKPDRSLDLGGSMVIKFVDALQERGFLPYHIFFDKVFTSVKLMSILRKKGVKATGTVREYRTERCPLKDPKELKKMKRGSFDYKVDESEEIIVCRWHDSSVVNICSNAVGIEPVRLTSRHSGAAKTRTQVHQPSLVKLYQEKVGGVGRMDQNIAKYKVKIRGMKWYSSFIGYVIDAALNNAWQLHRICCQDAQVDLLAFRRYIACVYLESNADTTSQGRRSRRLETESRFDMIGHWIIHQDKRTRCALCHSQTNTRCEKCQKGVHAKCFREYHIR

SEQ ID NO: 63736 - protein, 341 aa, Homo sapiens
  Payload ID: 12713
  Gene Symbol: PGBD2
  Gene Name: piggyBac transposable element derived 2
  Uniprot ID: Q6P3X8
  ENSP ID: ENSP00000355424
MNCNFQKHAPLEEFYSFGESMCEYFGHRGSKQLHRGKPVRLGYKIWCGTTSRGYLVWFEPSQGTLFTKPDRSLDLGGSMVIKFVDALQERGFLPYHIFFDKVFTSVKLMSILRKKGVKATGTVREYRTERCPLKDPKELKKMKRGSFDYKVDESEEIIVCRWHDSSVVNICSNAVGIEPVRLTSRHSGAAKTRTQVHQPSLVKLYQEKVGGVGRMDQNIAKYKVKIRGMKWYSSFIGYVIDAALNNAWQLHRICCQDAQVDLLAFRRYIACVYLESNADTTSQGRRSRRLETESRFDMIGHWIIHQDKRTRCALCHSQTNTRCEKCQKGVHAKCFREYHIR

SEQ ID NO: 63737 - protein, 593 aa, Homo sapiens
  Payload ID: 12714
  Gene Symbol: PGBD3
  Gene Name: piggyBac transposable element derived 3
  Uniprot ID: Q8N328
  ENSP ID: ENSP00000363242
MPRTLSLHEITDLLETDDSIEASAIVIQPPENATAPVSDEESGDEEGGTINNLPGSLLHTAAYLIQDGSDAESDSDDPSYAPKDDSPDEVPSTFTVQQPPPSRRRKMTKILCKWKKADLTVQPVAGRVTAPPNDFFTVMRTPTEILELFLDDEVIELIVKYSNLYACSKGVHLGLTSSEFKCFLGIIFLSGYVSVPRRRMFWEQRTDVHNVLVSAAMRRDRFETIFSNLHVADNANLDPVDKFSKLRPLISKLNERCMKFVPNETYFSFDEFMVPYFGRHGCKQFIRGKPIRFGYKFWCGATCLGYICWFQPYQGKNPNTKHEEYGVGASLVLQFSEALTEAHPGQYHFVFNNFFTSIALLDKLSSMGHQATGTVRKDHIDRVPLESDVALKKKERGTFDYRIDGKGNIVCRWNDNSVVTVASSGAGIHPLCLVSRYSQKLKKKIQVQQPNMIKVYNQFMGGVDRADENIDKYRASIRGKKWYSSPLLFCFELVLQNAWQLHKTYDEKPVDFLEFRRRVVCHYLETHGHPPEPGQKGRPQKRNIDSRYDGINHVIVKQGKQTRCAECHKNTTFRCEKCDVALHVKCSVEYHTE

SEQ ID NO: 63738 - protein, 585 aa, Homo sapiens
  Payload ID: 12715
  Gene Symbol: PGBD4
  Gene Name: piggyBac transposable element derived 4
  Uniprot ID: Q96DM1
  ENSP ID: ENSP00000380872
MSNPRKRSIPMRDSNTGLEQLLAEDSFDESDFSEIDDSDNFSDSALEADKIRPLSHLESDGKSSTSSDSGRSMKWSARAMIPRQRYDFTGTPGRKVDVSDITDPLQYFELFFTEELVSKITRETNAQAALLASKPPGPKGFSRMDKWKDTDNDELKVFFAVMLLQGIVQKPELEMFWSTRPLLDTPYLRQIMTGERFLLLFRCLHFVNNSSISAGQSKAQISLQKIKPVFDFLVNKFSTVYTPNRNIAVDESLMLFKGPLAMKQYLPTKRVRFGLKLYVLCESQSGYVWNALVHTGPGMNLKDSADGLKSSRIVLTLVNDLLGQGYCVFLDNFNISPMLFRELHQNRTDAVGTARLNRKQIPNDLKKRIAKGTTVARFCGELMALKWCDGKEVTMLSTFHNDTVIEVNNRNGKKTKRPRVIVDYNENMGAVDSADQMLTSYPSERKRHKVWYKKFFHHLLHITVLNSYILFKKDNPEHTMSHINFRLALIERMLEKHHKPGQQHLRGRPCSDDVTPLRLSGRHFPKSIPATSGKQNPTGRCKICCSQYDKDGKKIRKETRYFCAECDVPLCVVPCFEIYHTKKNY

SEQ ID NO: 63739 - protein, 409 aa, Homo sapiens [sequence omitted]

SEQ ID NO: 63740 - protein, 455 aa, Homo sapiens
  Payload ID: 12716
  Gene Symbol: PGBD5
  Gene Name: piggyBac transposable element derived 5
  Uniprot ID: Q8N414
  ENSP ID: ENSP00000431404
MPDYRTRALFVQSTLGDSAGPELQLLSIVPGRDLQPSDSFTGPTRKMPPSASAVDFFQLFVPDNVLKNMVVQTNMYAKKFQERFGSDGAWVEVTLTEMKAFLGYMISTSISHCESVLSIWSGGFYSNRSLALVMSQARFEKILKYFHVVAFRSSQTTHGLYKVQPFLDSLQNSFDSAFRPSQTQVLHEPLIDEDPVFIATCTERELRKRKKRKFSLWVRQCSSTGFIIQIYVHLKEGGGPDGLDALKNKPQLHSMVARSLCRNAAGKNYIIFTGPSITSLTLFEEFEKQGIYCCGLLRARKSDCTGLPLSMLTNPATPPARGQYQIKMKGNMSLICWYNKGHFRFLTNAYSPVQQGVIIKRKSGEIPCPLAVEAFAAHLSYICRYDDKYSKYFISHKPNKTWQQVFWFAISIAINNAYILYKMSDAYHVKRYSRAQFGERLVRELLGLEDASPTH

SEQ ID NO: 63741 - protein, 114 aa, Homo sapiens
  Payload ID: 12717
  Gene Symbol: PYURF
  Gene Name: PIGY upstream reading frame
  Uniprot ID: Q96I23
  ENSP ID: ENSP00000273968
MLSGARCRLASALRGTRAPPSAVARRCLHASGSRPLADRGKKTEEPPRDFDPALLEFLVCPLSKKPLRYEASTNELINEELGIAYPIIDGIPNMIPQAARMTRQSKKQEEVEQR

SEQ ID NO: 63742 - protein, 290 aa, Homo sapiens
  Payload ID: 12718
  Gene Symbol: PIH1D1
  Gene Name: PIH1 domain containing 1
  Uniprot ID: Q9NWS0
  ENSP ID: ENSP00000262265
MANPKLLGMGLSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPEWRMMKNRPFMGSISQQNIRSEQRPRIQELGDLYTPAPGRAESGPEKPHLNLWLEAPDLLLAEVDLPKLDGALGLSLEIGENRLVMGGPQQLYHLDAYIPLQINSHESKAAFHRKRKQLMVAMPLLPVPS

SEQ ID NO: 63743 - protein, 236 aa, Homo sapiens
  Payload ID: 12718
  Gene Symbol: PIH1D1
  Gene Name: PIH1 domain containing 1
  ENSP ID: ENSP00000469087
MANPKLLGMGLSEAEAIGADSARFEELLLQASKELQQAQTTRPESTQIQPQPGFCIKTNSSEGKVFINICHSPSIPPPADVTEEELLQMLEEDQAGFRIPMSLGEPHAELDASQCPQRTQESGPLGPFFPRTQESWAQDPPPSAPGDLAPRSDSFPYEGQGCTAYDVAVNSDFYRRMQNSDFLRELVITIAREGLEDKYNLQLNPEWRMMKNRPFMGSISQQNIRSEQRPRIQELG

SEQ ID NO: 63744 - protein, 273 aa, Homo sapiens
  Payload ID: 12718
  Gene Symbol: PIH1D1
  Gene Name: PIH1 domain containing 1
  ENSP ID: ENSP00000469693
MGLQFPECTKAGTRPRGIEASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPEWRMMKNRPFMGSISQQNIRSEQRPRIQELGDLYTPAPGRAESGPEKPHLNLWLEAPDLLLAEVDLPKLDGALGLSLEIGENRLVMGGPQQLYHLDAYIPLQINSHESKAAFHRKRKQLMVAMP

SEQ ID NO: 63745 - protein, 164 aa, Homo sapiens
  Payload ID: 12718
  Gene Symbol: PIH1D1
  Gene Name: PIH1 domain containing 1
  ENSP ID: ENSP00000469793
MGLQFPECTKAGTRPRGIEASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPEWRMMKNRPFMGSIS

SEQ ID NO: 63746 - protein, 54 aa, Homo sapiens
  Payload ID: 12718
  Gene Symbol: PIH1D1
  Gene Name: PIH1 domain containing 1
  ENSP ID: ENSP00000470322
  MOD_RES (1)..(1): Any amino acid
XGQGCTAYDVAVNSDFYRRMQNSDFLRELVITIAREGLEDKYNLQLNPGLKSLT

SEQ ID NO: 63747 - protein, 290 aa, Homo sapiens; identical to SEQ ID NO: 63742
  Payload ID: 12718
  Gene Symbol: PIH1D1
  Gene Name: PIH1 domain containing 1
  Uniprot ID: Q9NWS0
  ENSP ID: ENSP00000470445

SEQ ID NO: 63748 - protein, 129 aa, Homo sapiens
  Payload ID: 12718
  Gene Symbol: PIH1D1
  Gene Name: PIH1 domain containing 1
  ENSP ID: ENSP00000470639
KTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPAEHPLGAASSDPGAGGPVHARPRES

SEQ ID NO: 63749 - protein, 55 aa, Homo sapiens
  Payload ID: 12718
  Gene Symbol: PIH1D1
  Gene Name: PIH1 domain containing 1
  ENSP ID: ENSP00000470875
  MOD_RES (1)..(1): Any amino acid
XRMQNSDFLRELVITIAREGLEDKYNLQLNPEHPLGAASSDPGAGGPVHARPRES

SEQ ID NO: 63750 - protein, 87 aa, Homo sapiens
  Payload ID: 12718
  Gene Symbol: PIH1D1
  Gene Name: PIH1 domain containing 1
  ENSP ID: ENSP00000470947
RIPMSLGEPHAELDAKGQGCTAYDVAVNSDFYRRMQNSDFLRELVITIAREGLEDKYNLQLNPEHPLGAASSDPGAGGPVHARPRES

SEQ ID NO: 63751 - protein, 82 aa, Homo sapiens
  Payload ID: 12718
  Gene Symbol: PIH1D1
  Gene Name: PIH1 domain containing 1
  ENSP ID: ENSP00000471275
MANPKLLGMGLSEAEAIGADSARFEELLLQASKELQQAQTTRPESTQIQPQPGFCIKTNSSEGKVFINICHSPSIPPPADVT

SEQ ID NO: 63752 - protein, 95 aa, Homo sapiens
  Payload ID: 12718
  Gene Symbol: PIH1D1
  Gene Name: PIH1 domain containing 1
  ENSP ID: ENSP00000472065
LQQAQTTRPESTQIQPQPGFCIKTNSSEGKVFINICHSPSIPPPADVTEEELLQMLEEDQAGFRIPMSLGEPHAELDAKQRFLAGARDHHRQGGP

SEQ ID NO: 63753 - protein, 35 aa, Homo sapiens
  Payload ID: 12718
  Gene Symbol: PIH1D1
  Gene Name: PIH1 domain containing 1
  ENSP ID: ENSP00000472571
MGLQFPECTKAGTRPRGIELSCIRIAPFEEQMRGL

SEQ ID NO: 63754 - protein, 114 aa, Homo sapiens
  Payload ID: 12718
  Gene Symbol: PIH1D1
  Gene Name: PIH1 domain containing 1
  ENSP ID: ENSP00000472715
  MOD_RES (1)..(1): Any amino acid
XDVAVNSDFYRRMQNSDFLRELVITIAREGLEDKYNLQLNPEWRMMKNRPFMGSISQQNIRSEQRPRIQELGDLYTPAPGRAESGPEKPHLNLWLEAPDLLLAEVDLPKLTLQI

SEQ ID NO: 63755 - protein, 183 aa, Homo sapiens
  Payload ID: 12718
  Gene Symbol: PIH1D1
  Gene Name: PIH1 domain containing 1
  ENSP ID: ENSP00000473095
  MOD_RES (1)..(1): Any amino acid
XPPPADVTEEELLQMLEEDQAGFRIPMSLGEPHAELDAKGQGCTAYDVAVNSDFYRRMQNSDFLRELVITIAREGLEDKYNLQLNPEWRMMKNRPFMGSISQQNIRSEQRPRIQELGDLYTPAPGRAESGPEKPHLNLWLEAPDLLLAEVDLPKLINSHESKAAFHRKRKQLMVAMPLLPVPS

SEQ ID NO: 63756 - protein, 115 aa, Homo sapiens
  Payload ID: 12718
  Gene Symbol: PIH1D1
  Gene Name: PIH1 domain containing 1
  ENSP ID: ENSP00000473100
  MOD_RES (1)..(1): Any amino acid
XAIGADSARFEELLLQASKELQQAQTTRPESTQIQPQPGFCIKTNSSEGKVFINICHSPSIPPPADVTEEELLQMLEEDQAGFRIPMSLGEPHAELDAKQRFLAGARDHHRQGGP

SEQ ID NO: 63757 - protein, 315 aa, Homo sapiens
  Payload ID: 12719
  Gene Symbol: PIH1D2
  Gene Name: PIH1 domain containing 2
  Uniprot ID: Q8WWB5
  ENSP ID: ENSP00000280350
METSSKGLLTQVTQFWNLLDDLAQSDPEGYEKFIQQQLKEGKQLCAAPEPQLCLQTRILKPKEKILFINLCQWTRIPAPQSTTHPVPLTVGKPEDTTEISDAYTVIDVAYNPDVLHAAEKDQVKKNQLIQMAMKCIEEKFQFTLSHSYHITKFRIKGSIQRMKQNLMGIQTDSIDLREKMRRELTLGQIRSSTMSNPDHFPQLLLPKDQVSGKAVCLIEEISSTEIQVEMKMPAYELKIVHDHSEKPLKIELKVELPGINSVSLCDLSVSEDDLLIEVSEKYRLHLNLPKLIDTEMTTAKFIKEKSTLIITMPLV

SEQ ID NO: 63758 - protein, 288 aa, Homo sapiens
  Payload ID: 12719
  Gene Symbol: PIH1D2
  Gene Name: PIH1 domain containing 2
  Uniprot ID: Q8WWB5
  ENSP ID: ENSP00000388209
METSSKGLLTQVTQFWNLLDDLAQSDPEGYEKFIQQQLKEGKQLCAAPEPQLCLQTRILKPKEKILFINLCQWTRIPAPQSTTHPVPLTVGKPEDTTEISDAYTVIDVAYNPDVLHAAEKDQVKKNQLIQMAMKCIEEKFQFTLSHSYHITKFRIKGSIQRMKQNLMGIQTDSIDLREKMRRELTLGQIRSSTMSNPDHFPQLLLPKDQVSGKAVCLIEEISSTEIQVEMKMPAYELKIVHDHSEKPLKIELKVELPGINSVSLCDLSVSEGTTEPQALAKDELSLKF

SEQ ID NO: 63759 - protein, 273 aa, Homo sapiens
  Payload ID: 12719
  Gene Symbol: PIH1D2
  Gene Name: PIH1 domain containing 2
  Uniprot ID: Q8WWB5
  ENSP ID: ENSP00000431147
METSSKGLLTQVTQFWNLLDDLAQSDPEGYEKFIQQQLKEGKQLCAAPEPQLCLQTRILKPKEKILFINLCQWTRIPAPQSTTHPVPLTVGKPEDTTEISDAYTVIDVAYNPDVLHAAEKDQVKKNQLIQMAMKCIEEKFQFTLSHSYHITKFRIKGSIQRMKQNLMGIQTDSIDLREKMRRELTLGQIRSSTMSNPDHFPQLLLPKDQVSGKAVCLIEEISSTEIQVEMKMPAYELKIVHDHSEKPLKIELKVELPGINSVSLCDLSVSEVS

SEQ ID NO: 63760 - protein, 252 aa, Homo sapiens
  Payload ID: 12719
  Gene Symbol: PIH1D2
  Gene Name: PIH1 domain containing 2
  ENSP ID: ENSP00000431336
  MOD_RES (1)..(1): Any amino acid
XGYEKFIQQQLKEGKQLCAAPEPQLCLQTRILKPKEKILFINLCQWTRIPAPQSTTHPVPLTVGKPEDTTEISAEKDQVKKNQLIQMAMKCIEEKFQFTLSHSYHITKFRIKGSIQRMKQNLMGIQTDSIDLREKMRRELTLGQIRSSTMSNPDHFPQLLLPKDQVSGKAVCLIEEISSTEIQVEMKMPAYELKIVHDHSEKPLKIELKVELPGINSVSLCDLSVSEDDLLIEVSEKYRLHLNLPKLIDTEM

SEQ ID NO: 63761 - protein, 315 aa, Homo sapiens; identical to SEQ ID NO: 63757
  Payload ID: 12719
  Gene Symbol: PIH1D2
  Gene Name: PIH1 domain containing 2
  Uniprot ID: Q8WWB5
  ENSP ID: ENSP00000431841

SEQ ID NO: 63762 - protein, 162 aa, Homo sapiens
  Payload ID: 12719
  Gene Symbol: PIH1D2
  Gene Name: PIH1 domain containing 2
  ENSP ID: ENSP00000433297
QQLKEGKQLCAAPEPQLCLQTRILKPKEKILFINLCQWTRIPAPQSTTHPVPLTVGKPEDTTEISDAYTVIDVAYNPDVLHAAEKDQVKKNQLIQMAMKCIEEKFQFTLSHSYHITKFRIKGSIQRMKQNLMGIQTDSIDLREKMRRGKLMIVNGKLNCFKM

SEQ ID NO: 63763 - protein, 288 aa, Homo sapiens; identical to SEQ ID NO: 63758
  Payload ID: 12719
  Gene Symbol: PIH1D2
  Gene Name: PIH1 domain containing 2
  Uniprot ID: Q8WWB5
  ENSP ID: ENSP00000434275

SEQ ID NO: 63764 - protein, 214 aa, Homo sapiens
  Payload ID: 12720
  Gene Symbol: PIH1D3
  Gene Name: PIH1 domain containing 3
  Uniprot ID: Q9NQM4
  ENSP ID: ENSP00000337757
MESENMDSENMKTENMESQNVDFESVSSVTALEALSKLLNPEEEDDSDYGQTNGLSTIGAMGPGNIGPPQIEELKVIPETSEENNEDIWNSEEIPEGAEYDDMWDVREIPEYEIIFRQQVGTEDIFLGLSKKDSSTGCCSELVAKIKLPNTNPSDIQIDIQETILDLRTPQKKLLITLPELVECTSAKAFYIPETETLEITMTMKRELDIANFF

SEQ ID NO: 63765 - protein, 214 aa, Homo sapiens; identical to SEQ ID NO: 63764
  Payload ID: 12720
  Gene Symbol: PIH1D3
  Gene Name: PIH1 domain containing 3
  Uniprot ID: Q9NQM4
  ENSP ID: ENSP00000361531

SEQ ID NO: 63766 - protein, 214 aa, Homo sapiens; identical to SEQ ID NO: 63764
  Payload ID: 12720
  Gene Symbol: PIH1D3
  Gene Name: PIH1 domain containing 3
  Uniprot ID: Q9NQM4
  ENSP ID: ENSP00000441930

SEQ ID NO: 63767 - protein, 282 aa, Homo sapiens
  Payload ID: 12721
  Gene Symbol: PIANP
  Gene Name: PILR alpha associated neural protein
  Uniprot ID: Q8IYJ0
  ENSP ID: ENSP00000317818
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGRGEGVDPQLYVTITISIIIVLVATGIIFKFCWDRSQKRRRPSGQQGALRQEESQQPLTDLSPAGVTVLGAFGDSPTPTPDHEEPRGGPRPGMPHPKGAPAFQLNRIPLVNL

SEQ ID NO: 63768 - protein, 76 aa, Homo sapiens
  Payload ID: 12721
  Gene Symbol: PIANP
  Gene Name: PILR alpha associated neural protein
  ENSP ID: ENSP00000438736
MESRMWPALLLSHLLPLWPLLLLPLPPPAQGSSSSPRTPPAPARPPCARGGPSAPRHVCVWERAPPPSRSPRVPRS

SEQ ID NO: 63769 - protein, 282 aa, Homo sapiens; identical to SEQ ID NO: 63767
  Payload ID: 12721
  Gene Symbol: PIANP
  Gene Name: PILR alpha associated neural protein
  Uniprot ID: Q8IYJ0
  ENSP ID: ENSP00000442157

SEQ ID NO: 63770 - protein, 110 aa, Homo sapiens
  Payload ID: 12721
  Gene Symbol: PIANP
  Gene Name: PILR alpha associated neural protein
  ENSP ID: ENSP00000443898
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGP

SEQ ID NO: 63771 - protein, 276 aa, Homo sapiens
  Payload ID: 12721
  Gene Symbol: PIANP
  Gene Name: PILR alpha associated neural protein
  Uniprot ID: Q8IYJ0
  ENSP ID: ENSP00000443919
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGRGEGVDPQLYVTITISIIIVLVATGIIFKFCWDRSQKRRRPSGQQGALRQEESQQPLTDLSPAGVTVLGAFGDSPTPTPDHEEPRGGPRPGMPHPKGAPAFQLNR

SEQ ID NO: 63772 - protein, 171 aa, Homo sapiens
  Payload ID: 12721
  Gene Symbol: PIANP
  Gene Name: PILR alpha associated neural protein
  ENSP ID: ENSP00000444605
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGG

SEQ ID NO: 63773 - protein, 313 aa, Homo sapiens
  Payload ID: 12722
  Gene Symbol: PIM1
  Gene Name: Pim-1 proto-oncogene, serine/threonine kinase
  Uniprot ID: P11309
  ENSP ID: ENSP00000362608
MLLSKINSLAHLRAAPCNDLHATKLAPGKEKEPLESQYQVGPLLGSGGFGSVYSGIRVSDNLPVAIKHVEKDRISDWGELPNGTRVPMEVVLLKKVSSGFSGVIRLLDWFERPDSFVLILERPEPVQDLFDFITERGALQEELARSFFWQVLEAVRHCHNCGVLHRDIKDENILIDLNRGELKLIDFGSGALLKDTVYTDFDGTRVYSPPEWIRYHRYHGRSAAVWSLGILLYDMVCGDIPFEHDEEIIRGQVFFRQRVSSECQHLIRWCLALRPSDRPTFEEIQNHPWMQDVLLPQETAEIHLHSLSPGPSK

SEQ ID NO: 63774 - protein, 311 aa, Homo sapiens
  Payload ID: 12723
  Gene Symbol: PIM2
  Gene Name: Pim-2 proto-oncogene, serine/threonine kinase
  Uniprot ID: Q9P1W9
  ENSP ID: ENSP00000365692
MLTKPLQGPPAPPGTPTPPPGGKDREAFEAEYRLGPLLGKGGFGTVFAGHRLTDRLQVAIKVIPRNRVLGWSPLSDSVTCPLEVALLWKVGAGGGHPGVIRLLDWFETQEGFMLVLERPLPAQDLFDYITEKGPLGEGPSRCFFGQVVAAIQHCHSRGVVHRDIKDENILIDLRRGCAKLIDFGSGALLHDEPYTDFDGTRVYSPPEWISRHQYHALPATVWSLGILLYDMVCGDIPFERDQEILEAELHFPAHVSPDCCALIRRCLAPKPSSRPSLEEILLDPWMQTPAEDVPLNPSKGGPAPLAWSLLP

SEQ ID NO: 63775 - protein, 145 aa, Homo sapiens
  Payload ID: 12723
  Gene Symbol: PIM2
  Gene Name: Pim-2 proto-oncogene, serine/threonine kinase
  ENSP ID: ENSP00000410960
MLVLERPLPAQDLFDYITEKGPLGEGPSRCFFGQVVAAIQHCHSRGVVHRDIKDENILIDLRRGCAKLIDFGSGALLHDEPYTDFDGTRVYSPPEWISRHQYHALPATVWSLGILLYDMVCGDIPFERDQEILEAELHFPAHVSP

SEQ ID NO: 63776 - protein, 326 aa, Homo sapiens
  Payload ID: 12724
  Gene Symbol: PIM3
  Gene Name: Pim-3 proto-oncogene, serine/threonine kinase
  Uniprot ID: Q86V86
  ENSP ID: ENSP00000353824
MLLSKFGSLAHLCGPGGVDHLPVKILQPAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGTRVYSPPEWIRYHRYHGRSATVWSLGVLLYDMVCGDIPFEQDEEILRGRLLFRRRVSPECQQLIRWCLSLRPSERPSLDQIAAHPWMLGADGGVPESCDLRLCTLDPDDVASTTSSSESL

SEQ ID NO: 63777 - protein, 328 aa, Homo sapiens
  Payload ID: 12725
  Gene Symbol: PINX1
  Gene Name: PIN2/TERF1 interacting, telomerase inhibitor 1
  Uniprot ID: Q96BK5
  ENSP ID: ENSP00000318966
MSMLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKGKDLSSRSKTDLDCIFGKRQSKKTPEGDASPSTPEENETTTTSAFTIQEYFAKRMAALKNKPQVPVPGSDISETQVERKRGKKRNKEATGKDVESYLQPKAKRHTEGKPERAEAQERVAKKKSAPAEEQLRGPCWDQSSKASAQDAGDHVQPPEGRDFTLKPKKRRGKKKLQKPVEIAEDATLEETLVKKKKKKDSK

SEQ ID NO: 63778 - protein, 134 aa, Homo sapiens
  Payload ID: 12725
  Gene Symbol: PINX1
  Gene Name: PIN2/TERF1 interacting, telomerase inhibitor 1
  ENSP ID: ENSP00000428242
MSMLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKVYC

SEQ ID NO: 63779 - protein, 198 aa, Homo sapiens
  Payload ID: 12725
  Gene Symbol: PINX1
  Gene Name: PIN2/TERF1 interacting, telomerase inhibitor 1
  ENSP ID: ENSP00000428728
MSMLAERECRKRRPDPGRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKGKDLSSRSKTDLDCIFGKRQSKKTPEGDASPSTPEENETTTTSAFTIQEYFAKRMAA

SEQ ID NO: 63780 - protein, 174 aa, Homo sapiens
  Payload ID: 12725
  Gene Symbol: PINX1
  Gene Name: PIN2/TERF1 interacting, telomerase inhibitor 1
  Uniprot ID: Q96BK5
  ENSP ID: ENSP00000428853
MSMLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKGRCQSLHSRGERNHDNQRLHHPGVLCQADGSTEEQAPGSSSRV

SEQ ID NO: 63781 - protein, 19 aa, Homo sapiens
  Payload ID: 12725
  Gene Symbol: PINX1
  Gene Name: PIN2/TERF1 interacting, telomerase inhibitor 1
  ENSP ID: ENSP00000429346
  MOD_RES (1)..(1): Any amino acid
XMKFTKGRTVLLKSITLFF

SEQ ID NO: 63782 - protein, 717 aa, Homo sapiens
  Payload ID: 12726
  Gene Symbol: PNN
  Gene Name: pinin, desmosome associated protein
  Uniprot ID: Q9H307
  ENSP ID: ENSP00000216832
MAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVENERRELFEERRAKQTELRLLEQKVELAQLQEEWNEHNAKIIKYIRTKTKPHLFYIPGRMCPATQKLIEESQRKMNALFEGRRIEFAEQINKMEARPRRQSMKEKEHQVVRNEEQKAEQEEGKVAQREEELEETGNQHNDVEIEEAGEEEEKEIAIVHSDAEKEQEEEEQKQEMEVKMEEETEVRESEKQQDSQPEEVMDVLEMVENVKHVIADQEVMETNRVESVEPSENEASKELEPEMEFEIEPDKECKTLSPGKENVSALDMEKESEEKEEKESEPQPEPVAQPQPQSQPQLQLQSQSQPVLQSQPPSQPEDLSLAVLQPTPQVTQEQGHLLPERKDFPVESVKLTEVPVEPVLTVHPESKSKTKTRSRSRGRARNKTSKSRSRSSSSSSSSSSSTSSSSGSSSSSGSSSSRSSSSSSSSTSGSSSRDSSSSTSSSSESRSRSRGRGHNRDRKHRRSVDRKRRDTSGLERSHKSSKGGSSRDTKGSKDKNSRSDRKRSISESSRSGKRSSRSERDRKSDRKDKRR

SEQ ID NO: 63783 - protein, 124 aa, Homo sapiens
  Payload ID: 12726
  Gene Symbol: PNN
  Gene Name: pinin, desmosome associated protein
  ENSP ID: ENSP00000452217
MAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKEPANIWLVDGYPSKI

SEQ ID NO: 63784 - protein, 117 aa, Homo sapiens
  Payload ID: 12726
  Gene Symbol: PNN
  Gene Name: pinin, desmosome associated protein
  ENSP ID: ENSP00000452318
MAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKVLRLKELK

SEQ ID NO: 63785 - protein, 390 aa, Homo sapiens
  Payload ID: 12727
  Gene Symbol: PIPOX
  Gene Name: pipecolic acid oxidase
  Uniprot ID: Q9P0Z9
  ENSP ID: ENSP00000317721
MAAQKDLWDAIVIGAGIQGCFTAYHLAKHRKRILLLEQFFLPHSRGSSHGQSRIIRKAYLEDFYTRMMHECYQIWAQLEHEAGTQLHRQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPLQTLRINVCYWREMVPGSYGVSQAFPCFLWLGLCPHHIYGLPTGEYPGLMKVSYHHGNHADPEERDCPTARTDIGDVQILSSFVRDHLPDLKPEPAVIESCMYTNTPDEQFILDRHPKYDNIVIGAGFSGHGFKLAPVVGKILYELSMKLTPSYDLAPFRISRFPSLGKAHL

SEQ ID NO: 63786 - protein, 204 aa, Homo sapiens
  Payload ID: 12727
  Gene Symbol: PIPOX
  Gene Name: pipecolic acid oxidase
  ENSP ID: ENSP00000465329
MMHECYQIWAQLEHEAGTQLHRQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPLQTLRINVCYWREMVPGSYGVSQAFPCFLWLGLCPHHIYGLPTGEYPGLMKV

SEQ ID NO: 63787 - protein, 153 aa, Homo sapiens
  Payload ID: 12727
  Gene Symbol: PIPOX
  Gene Name: pipecolic acid oxidase
  ENSP ID: ENSP00000465428
MMHECYQIWAQLEHEAGTQLHRQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPL

SEQ ID NO: 63788 - protein, 290 aa, Homo sapiens
  Payload ID: 12728
  Gene Symbol: PIR
  Gene Name: pirin (iron-binding nuclear protein)
  Uniprot ID: O00625
  ENSP ID: ENSP00000369785
MGSSKKVTLSVLSREQSEGVGARVRRSIGRPELKNLDPFLLFDEFKGGRPGGFPDHPHRGFETVSYLLEGGSMAHEDFCGHTGKMNPGDLQWMTAGRGILHAEMPCSEEPAHGLQLWVNLRSSEKMVEPQYQELKSEEIPKPSKDGVTVAVISGEALGIKSKVYTRTPTLYLDFKLDPGAKHSQPIPKGWTSFIYTISGDVYIGPDDAQQKIEPHHTAVLGEGDSVQVENKDPKRSHFVLIAGEPLREPVIQHGPFVMNTNEEISQAILDFRNAKNGFERAKTWKSKIGN

SEQ ID NO: 63789 - protein, 290 aa, Homo sapiens; identical to SEQ ID NO: 63788
  Payload ID: 12728
  Gene Symbol: PIR
  Gene Name: pirin (iron-binding nuclear protein)
  Uniprot ID: O00625
  ENSP ID: ENSP00000369786

SEQ ID NO: 63790 - protein, 211 aa, Homo sapiens
  Payload ID: 12729
  Gene Symbol: PITHD1
  Gene Name: PITH (C-terminal proteasome-interacting domain of thioredoxin-like) domain containing 1
  Uniprot ID: Q9GZP4
  ENSP ID: ENSP00000246151
MSHGHSHGGGGCRCAAEREEPPEQRGLAYGLYLRIDLERLQCLNESREGSGRGVFKPWEERTDRSKFVESDADEELLFNIPFTGNVKLKGIIIMGEDDDSHPSEMRLYKNIPQMSFDDTEREPDQTFSLNRDLTGELEYATKISRFSNVYHLSIHISKNFGADTTKVFYIGLRGEWTELRRHEVTICNYEASANPADHRVHQVTPQTHFIS

SEQ ID NO: 63791 - protein, 98 aa, Homo sapiens
  Payload ID: 12729
  Gene Symbol: PITHD1
  Gene Name: PITH (C-terminal proteasome-interacting domain of thioredoxin-like) domain containing 1
  ENSP ID: ENSP00000363648
MSFDDTEREPDQTFSLNRDLTGELEYATKISRFSNVYHLSIHISKNFGADTTKVFYIGLRGEWTELRRHEVTICNYEASANPADHRVHQVTPQTHFIS

SEQ ID NO: 63792 - protein, 70 aa, Homo sapiens
  Payload ID: 12729
  Gene Symbol: PITHD1
  Gene Name: PITH (C-terminal proteasome-interacting domain of thioredoxin-like) domain containing 1
  ENSP ID: ENSP00000405957
MGEDDDSHPSEMRLYKNIPQMSFDDTEREPDQTFSLNRDLTGELEYATKISRFSNVYHLSIHISKNFGAD

SEQ ID NO: 63793 - protein, 974 aa, Homo sapiens
  Payload ID: 12730
  Gene Symbol: PITPNM3
  Gene Name: PITPNM family member 3
  Uniprot ID: Q9BZ71
  ENSP ID: ENSP00000262483
MAKAGRAGGPPPGGGAPWHLRNVLSDSVESSDDEFFDAREEMAEGKNAILIGMSQWNSNDLVEQIETMGKLDEHQGEGTAPCTSSILQEKQRELYRVSLRRQRFPAQGSIEIHEDSEEGCPQRSCKTHVLLLVLHGGNILDTGAGDPSCKAADIHTFSSVLEKVTRAHFPAALGHILIKFVPCPAICSEAFSLVSHLNPYSHDEGCLSSSQDHVPLAALPLLAISSPQYQDAVATVIERANQVYREFLKSSDGIGFSGQVCLIGDCVGGLLAFDAICYSAGPSGDSPASSSRKGSISSTQDTPVAVEEDCSLASSKRLSKSNIDISSGLEDEEPKRPLPRKQSDSSTYDCEAITQHHAFLSSIHSSVLKDESETPAAGGPQLPEVSLGRFDFDVSDFFLFGSPLGLVLAMRRTVLPGLDGFQVRPACSQVYSFFHCADPSASRLEPLLEPKFHLVPPVSVPRYQRFPLGDGQSLLLADALHTHSPLFLEGSSRDSPPLLDAPASPPQASRFQRPGRRMSEGSSHSESSESSDSMAPVGASRITAKWWGSKRIDYALYCPDVLTAFPTVALPHLFHASYWESTDVVAFILRQVMRYESVNIKESARLDPAALSPANPREKWLRKRTQVKLRNVTANHRANDVIAAEDGPQVLVGRFMYGPLDMVALTGEKVDILVMAEPSSGRWVHLDTEITNSSGRITYNVPRPRRLGVGVYPVKMVVRGDQTCAMSYLTVLPRGMECVVFSIDGSFAASVSIMGSDPKVRPGAVDVVRHWQDLGYMILYITGRPDMQKQRVVSWLSQHNFPQGMIFFSDGLVHDPLRQKAIFLRNLMQECFIKISAAYGSTKDISVYSVLGLPASQIFIVGRPTKKYQTQCQFLSEGYAAHLAALEASHRSRPKKNNSRMILRKGSFGLHAQPEFLRKRNHLRRTMSVQQPDPPAANPKPERAQSQPESDKDHERPLPALSWARGPPKFESVP

SEQ ID NO: 63794 - protein, 938 aa, Homo sapiens
  Payload ID: 12730
  Gene Symbol: PITPNM3
  Gene Name: PITPNM family member 3
  Uniprot ID: Q9BZ71
  ENSP ID: ENSP00000407882
MAKAGRAGGPPPGGGAPWHLRNVLSDSVESSDDEFFDARGEGTAPCTSSILQEKQRELYRVSLRRQRFPAQGSIEIHEDSEEGCPQRSCKTHVLLLVLHGGNILDTGAGDPSCKAADIHTFSSVLEKVTRAHFPAALGHILIKFVPCPAICSEAFSLVSHLNPYSHDEGCLSSSQDHVPLAALPLLAISSPQYQDAVATVIERANQVYREFLKSSDGIGFSGQVCLIGDCVGGLLAFDAICYSAGPSGDSPASSSRKGSISSTQDTPVAVEEDCSLASSKRLSKSNIDISSGLEDEEPKRPLPRKQSDSSTYDCEAITQHHAFLSSIHSSVLKDESETPAAGGPQLPEVSLGRFDFDVSDFFLFGSPLGLVLAMRRTVLPGLDGFQVRPACSQVYSFFHCADPSASRLEPLLEPKFHLVPPVSVPRYQRFPLGDGQSLLLADALHTHSPLFLEGSSRDSPPLLDAPASPPQASRFQRPGRRMSEGSSHSESSESSDSMAPVGASRITAKWWGSKRIDYALYCPDVLTAFPTVALPHLFHASYWESTDVVAFILRQVMRYESVNIKESARLDPAALSPANPREKWLRKRTQVKLRNVTANHRANDVIAAEDGPQVLVGRFMYGPLDMVALTGEKVDILVMAEPSSGRWVHLDTEITNSSGRITYNVPRPRRLGVGVYPVKMVVRGDQTCAMSYLTVLPRGMECVVFSIDGSFAASVSIMGSDPKVRPGAVDVVRHWQDLGYMILYITGRPDMQKQRVVSWLSQHNFPQGMIFFSDGLVHDPLRQKAIFLRNLMQECFIKISAAYGSTKDISVYSVLGLPASQIFIVGRPTKKYQTQCQFLSEGYAAHLAALEASHRSRPKKNNSRMILRKGSFGLHAQPEFLRKRNHLRRTMSVQQPDPPAANPKPERAQSQPESDKDHERPLPALSWARGPPKFESVP

SEQ ID NO: 63795 - protein, 116 aa, Homo sapiens
  Payload ID: 12730
  Gene Symbol: PITPNM3
  Gene Name: PITPNM family member 3
  ENSP ID: ENSP00000458901
  MOD_RES (1)..(1): Any amino acid
XGDQTCAMSYLTVLPRGMECVVFSIDGSFAASVSIMGSDPKVRPGAVDVVRHWQDLGYMILYITGRPDMQKQRVVSWLSQHNFPQGMIFFSDGLVHDPLRQKAIFLRNLMQEMCFP

SEQ ID NO: 63796 - protein, 1037 aa, Homo sapiens
  Payload ID: 12731
  Gene Symbol: PITRM1
  Gene Name: pitrilysin metallopeptidase 1
  Uniprot ID: Q5JRX3
  ENSP ID: ENSP00000224949
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTISVSFLLPDITDTFEAFTLSLLSSLLTSGPNSPFYKALIESGLGTDFSPDVGYNGYTREAYFSVGLQGIAEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIQ

SEQ ID NO: 63797 - protein, 1038 aa, Homo sapiens
  Payload ID: 12731
  Gene Symbol: PITRM1
  Gene Name: pitrilysin metallopeptidase 1
  Uniprot ID: Q5JRX3
  ENSP ID: ENSP00000370377
MWRCGGRQGLCVLRRLSGGHAHHRAWRWNSNRACERALQYKLGDKIHGFTVNQVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTISVSFLLPDITDTFEAFTLSLLSSLLTSGPNSPFYKALIESGLGTDFSPDVGYNGYTREAYFSVGLQGIAEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQVGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIQ

SEQ ID NO: 63798 - protein, 595 aa, Homo sapiens
  Payload ID: 12731
  Gene Symbol: PITRM1
  Gene Name: pitrilysin metallopeptidase 1
  ENSP ID: ENSP00000370382
MWKSSFQYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTKLGCGLLDYREQAQQIELKTGGMSASPHVLPDDSHMDTYEQGVLFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIQ

SEQ ID NO: 63799 - protein, 233 aa, Homo sapiens
  Payload ID: 12731
  Gene Symbol: PITRM1
  Gene Name: pitrilysin metallopeptidase 1
  ENSP ID: ENSP00000391526
  MOD_RES (1)..(1): Any amino acid
XLIESGLGTDFSPDVGYNGYTREAYFSVGLQGIAEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTGHCERYAFPGSRVPWGN

SEQ ID NO: 63800 - protein, 184 aa, Homo sapiens
  Payload ID: 12731
  Gene Symbol: PITRM1
  Gene Name: pitrilysin metallopeptidase 1
  ENSP ID: ENSP00000399307
KPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGILSITVRISTHSLTDDVAVFQVPGMHGQEH

SEQ ID NO: 63801 - protein, 939 aa, Homo sapiens
  Payload ID: 12731
  Gene Symbol: PITRM1
  Gene Name: pitrilysin metallopeptidase 1
  Uniprot ID: Q5JRX3
  ENSP ID: ENSP00000401201
MRNVALRRAAGPVCAEAAERRVTSVPELFLTAVKLTHDDTGARYLHLAREDTNNLFSVQFRTTPMDSTGVPHILEHTVLCGSQKYPCRDPFFKMLNRSLSTFMNAFTASDYTLYPFSTQNPKDFQNLLSVYLDATFFPCLRELDFWQEGWRLEHENPSDPQTPLVFKGVVFNEMKGAFTDNERIFSQHLQNRLLPDHTYSVVSGGDPLCIPELTWEQLKQFHATHYHPSNARFFTYGNFPLEQHLKQIHEEALSKFQKIEPSTVVPAQTPWDKPREFQITCGPDSFATDPSKQTTISVSFLLPDITDTFEAFTLSLLSSLLTSGPNSPFYKALIESGLGTDFSPDVGYNGYTREAYFSVGLQGIAEKDIETVRSLIDRTIDEVVEKGFEDDRIEALLHKIEIQMKHQSTSFGLMLTSYIASCWNHDGDPVELLKLGNQLAKFRQCLQENPKFLQEKVKQYFKNNQHKLTLSMRPDDKYHEKQAQVEATKLKQKVEALSPGDRQQIYEKGLELRSQQSKPQDASCLPALKVSDIEPTIPVTELDVVLTAGDIPVQYCAQPTNGMVYFRAFSSLNTLPEELRPYVPLFCSVLTNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHASLKILARLMTAKFLHTEIREKGGAYGGGAKLSHNGIFTLYSYRDPNTIETLQSFGKAVDWAKSGKFTQQDIDEAKLSVFSTVDAPVAPSDKGMDHFLYGLSDEMKQAHREQLFAVSHDKLLAVSDRYLGTGKSTHGLAILGPENPKIAKDPSWIIQ

SEQ ID NO: 63802 - protein, 86 aa, Homo sapiens
  Payload ID: 12731
  Gene Symbol: PITRM1
  Gene Name: pitrilysin metallopeptidase 1
  ENSP ID: ENSP00000402072
VNATPQQMPQTEKAVEDFLRSIGRSKKERRPVRPHTVEKPVPSSSGGDAHVPHGSQVIRKLVMYTLRHHVKIGGLHVSFTVRNCVE

SEQ ID NO: 63803 - protein, 259 aa, Homo sapiens
  Payload ID: 12731
  Gene Symbol: PITRM1
  Gene Name: pitrilysin metallopeptidase 1
  ENSP ID: ENSP00000413687
  MOD_RES (1)..(1): Any amino acid
XFSSLCLDRNLPDMMQLWSEIFNNPCFEEEEHFKVLVKMTAQELANGIPDSGHLYASIRAGRTLTPAGDLQETFSGMDQVRLMKRIAEMTDIKPILRKLPRIKKHLLNGDNMRCSVNATPQQMPQTEKAVEDFLRSIGRSKKERRPVRPHTVEKPVPSSSGGDAHVPHGSQVIRKLVMEPTFKPWQMKTHFLMPFPVNYVGECIRTVPYTDPDHARKRPVCGSGDLGLISPRASSRSLCLCCRPSHHCLPRLLSEVDVF

SEQ ID NO: 63804 - protein, 202 aa, Homo sapiens
  Payload ID: 12732
  Gene Symbol: PTTG1
  Gene Name: pituitary tumor-transforming 1
  Uniprot ID: O95997
  ENSP ID: ENSP00000344936
MATLIYVDKENGEPGTRVVAKDGLKLGSGPSIKALDGRSQVSTPRFGKTFDAPPALPKATRKALGTVNRATEKSVKTKGPLKQKQPSFSAKKMTEKTVKAKSSVPASDDAYPEIEKFFPFNPLDFESFDLPEEHQIAHLPLSGVPLMILDEERELEKLFQLGPPSPVKMPSPPWESNLLQSPSSILSTLDVELPPVCCDIDI

SEQ ID NO: 63805 - protein, 202 aa, Homo sapiens; identical to SEQ ID NO: 63804
  Payload ID: 12732
  Gene Symbol: PTTG1
  Gene Name: pituitary tumor-transforming 1
  Uniprot ID: O95997
  ENSP ID: ENSP00000377536

SEQ ID NO: 63806 - protein, 202 aa, Homo sapiens; identical to SEQ ID NO: 63804
  Payload ID: 12732
  Gene Symbol: PTTG1
  Gene Name: pituitary tumor-transforming 1
  Uniprot ID: O95997
  ENSP ID: ENSP00000430642

SEQ ID NO: 63807 - protein, 121 aa, Homo sapiens
  Payload ID: 12732
  Gene Symbol: PTTG1
  Gene Name: pituitary tumor-transforming 1
  ENSP ID: ENSP00000431068
MPLPKVGGGFGGERSSLYTQYLSCTGILLLEYSYGKTFSSAIKALDGRSQVSTPRFGKTFDAPPALPKATRKALGTVNRATEKSVKTKGPLKQKQPSFSAKKMTEKTVKAKSSVPASDDAY

SEQ ID NO: 63808 - protein, 180 aa, Homo sapiens
  Payload ID: 12733
  Gene Symbol: PTTG1IP
  Gene Name: pituitary tumor-transforming 1 interacting protein
  Uniprot ID: P53801
  ENSP ID: ENSP00000328325
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 63809 - protein, 159 aa, Homo sapiens
  Payload ID: 12733
  Gene Symbol: PTTG1IP
  Gene Name: pituitary tumor-transforming 1 interacting protein
  ENSP ID: ENSP00000380983
MGQAVSCVLGRLQPVKCTGARRVGRRGLRKQTSQECLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 63810 - protein, 107 aa, Homo sapiens
  Payload ID: 12733
  Gene Symbol: PTTG1IP
  Gene Name: pituitary tumor-transforming 1 interacting protein
  ENSP ID: ENSP00000380984
MAPGVARGPTPYWRLRLGGAALLLLLIPVAAAQEPPGAACSQNTNKTCEECLKNVSCLWCNTNKACLDYPVTSVLPPASLCKLSSARWGVCWGLFKEENPYARFENN

SEQ ID NO: 63811 - protein, 142 aa, Homo sapiens
  Payload ID: 12733
  Gene Symbol: PTTG1IP
  Gene Name: pituitary tumor-transforming 1 interacting protein
  ENSP ID: ENSP00000395374
MAPGVARGPTPYWRLRLGGAALLLLLIPVAAAQEPPGAACSQNTNKTCEECLKNVSACLKKKTRMLDLKTTKALQHISPDASCEVHAPQPSPAGRPRGHCGLLTLASEPASLPGQAAGELPLKDSPLVLQTGDLLFPVHLCF

SEQ ID NO: 63812 - protein, 191 aa, Homo sapiens
  Payload ID: 12734
  Gene Symbol: PTTG2
  Gene Name: pituitary tumor-transforming 2
  Uniprot ID: Q9NZH5
  ENSP ID: ENSP00000424261
MATLIYVDKEIGEPGTRVAAKDVLKLESRPSIKALDGISQVLTRRFGKTYDAPSALPKATRKALGTVNRATEKSVKTNGPRKQKQPSFSAKKMTEKTVKTKSSVPASDDAYPEIEKFFPFNLLDFESFDLPEERQIAHLPLSGVPLMILDEEGELEKLFQLGPPSPVKMPSPPWECNLFAVSFKHSVDPGC

SEQ ID NO: 63813 - protein, 861 aa, Homo sapiens
  Payload ID: 12735
  Gene Symbol: PIWIL1
  Gene Name: piwi-like RNA-mediated gene silencing 1
  Uniprot ID: Q96J94
  ENSP ID: ENSP00000245255
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDGTILFLPKRLQQKVTEVFSKTRNGEDVRITITLTNELPPTSPTCLQFYNIIFRRLLKIMNLQQIGRNYYNPNDPIDIPSHRLVIWPGFTTSILQYENSIMLCTDVSHKVLRSETVLDFMFNFYHQTEEHKFQEQVSKELIGLVVLTKYNNKTYRVDDIDWDQNPKSTFKKADGSEVSFLEYYRKQYNQEITDLKQPVLVSQPKRRRGPGGTLPGPAMLIPELCYLTGLTDKMRNDFNVMKDLAVHTRLTPEQRQREVGRLIDYIHKNDNVQRELRDWGLSFDSNLLSFSGRILQTEKIHQGGKTFDYNPQFADWSKETRGAPLISVKPLDNWLLIYTRRNYEAANSLIQNLFKVTPAMGMQMRKAIMIEVDDRTEAYLRVLQQKVTADTQIVVCLLSSNRKDKYDAIKKYLCTDCPTPSQCVVARTLGKQQTVMAIATKIALQMNCKMGGELWRVDIPLKLVMIVGIDCYHDMTAGRRSIAGFVASINEGMTRWFSRCIFQDRGQELVDGLKVCLQAALRAWNSCNEYMPSRIIVYRDGVGDGQLKTLVNYEVPQFLDCLKSIGRGYNPRLTVIVVKKRVNTRFFAQSGGRLQNPLPGTVIDVEVTRPEWYDFFIVSQAVRSGSVSPTHYNVIYDNSGLKPDHIQRLTYKLCHIYYNWPGVIRVPAPCQYAHKLAFLVGQSIHREPNLSLSNRLYYL

SEQ ID NO: 63814 - protein, 172 aa, Homo sapiens
  Payload ID: 12735
  Gene Symbol: PIWIL1
  Gene Name: piwi-like RNA-mediated gene silencing 1
  ENSP ID: ENSP00000438582
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDGTILFLPK

SEQ ID NO: 63815 - protein, 150 aa, Homo sapiens
  Payload ID: 12735
  Gene Symbol: PIWIL1
  Gene Name: piwi-like RNA-mediated gene silencing 1
  ENSP ID: ENSP00000439096
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALL

SEQ ID NO: 63816 - protein, 122 aa, Homo sapiens
  Payload ID: 12735
  Gene Symbol: PIWIL1
  Gene Name: piwi-like RNA-mediated gene silencing 1
  ENSP ID: ENSP00000440677
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLT

SEQ ID NO: 63817 - protein, 165 aa, Homo sapiens
  Payload ID: 12735
  Gene Symbol: PIWIL1
  Gene Name: piwi-like RNA-mediated gene silencing 1
  ENSP ID: ENSP00000442086
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDG

SEQ ID NO: 63818 - protein, 117 aa, Homo sapiens
  Payload ID: 12735
  Gene Symbol: PIWIL1
  Gene Name: piwi-like RNA-mediated gene silencing 1
  ENSP ID: ENSP00000444353
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTN

SEQ ID NO: 63819 - protein, 861 aa, Homo sapiens; identical to SEQ ID NO: 63813
  Payload ID: 12735
  Gene Symbol: PIWIL1
  Gene Name: piwi-like RNA-mediated gene silencing 1
  Uniprot ID: Q96J94
  ENSP ID: ENSP00000481042

SEQ ID NO: 63820 - protein, 829 aa, Homo sapiens
  Payload ID: 12735
  Gene Symbol: PIWIL1
  Gene Name: piwi-like RNA-mediated gene silencing 1
  Uniprot ID: Q96J94
  ENSP ID: ENSP00000487688
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDGTILFLPKRLQQKVTEVFSKTRNGEDVRITITLTNELPPTSPTCLQFYNIIFRRLLKIMNLQQIGRNYYNPNDPIDIPSHRLVIWPGFTTSILQYENSIMLCTDVSHKVLRSETVLDFMFNFYHQTEEHKFQEQVSKELIGLVVLTKYNNKTYRVDDIDWDQNPKSTFKKADGSEVSFLEYYRKQYNQEITDLKQPVLVSQPKRRRGPGGTLPGPAMLIPELCYLTGLTDKMRNDFNVMKDLAVHTRLTPEQRQREVGRLIDYIHKNDNVQRELRDWGLSFDSNLLSFSGRILQTEKIHQGGKTFDYNPQFADWSKETRGAPLISVKPLDNWLLIYTRRNYEAANSLIQNLFKVTPAMGMQMRKAIMIEVDDRTEAYLRVLQQKVTADTQIVVCLLSSNRKDKYDAIKKYLCTDCPTPSQCVVARTLGKQQTVMAIATKIALQMNCKMGGELWRVDIPLKLVMIVGIDCYHDMTAGRRSIAGFVASINEGMTRWFSRCIFQDRGQELVDGLKVCLQAALRAWNSCNEYMPSRIIVYRDGVGDGQLKTLVNYEVPQFLDCLKSIGRGYNPRLTVIVVKKRVNTRFFAQSGGRLQNPLPGTVIDVEVTRPEWYDFFIVSQAVRSGSVSPTHYNVIYDNSGLKPDHIQRLTYKLCHIYYNWPVSASTC

SEQ ID NO: 63821 - protein, 165 aa, Homo sapiens; identical to SEQ ID NO: 63817
  Payload ID: 12735
  Gene Symbol: PIWIL1
  Gene Name: piwi-like RNA-mediated gene silencing 1
  ENSP ID: ENSP00000487799

SEQ ID NO: 63822 - protein, 122 aa, Homo sapiens; identical to SEQ ID NO: 63816
  Payload ID: 12735
  Gene Symbol: PIWIL1
  Gene Name: piwi-like RNA-mediated gene silencing 1
  ENSP ID: ENSP00000487920

SEQ ID NO: 63823 - protein, 172 aa, Homo sapiens; identical to SEQ ID NO: 63814
  Payload ID: 12735
  Gene Symbol: PIWIL1
  Gene Name: piwi-like RNA-mediated gene silencing 1
  ENSP ID: ENSP00000488197

SEQ ID NO: 63824 - protein, 117 aa, Homo sapiens; identical to SEQ ID NO: 63818
  Payload ID: 12735
  Gene Symbol: PIWIL1
  Gene Name: piwi-like RNA-mediated gene silencing 1
  ENSP ID: ENSP00000488677

SEQ ID NO: 63825 - protein, 150 aa, Homo sapiens; identical to SEQ ID NO: 63815
  Payload ID: 12735
  Gene Symbol: PIWIL1
  Gene Name: piwi-like RNA-mediated gene silencing 1
  ENSP ID: ENSP00000488716

SEQ ID NO: 63826 - protein, 973 aa, Homo sapiens
  Payload ID: 12736
  Gene Symbol: PIWIL2
  Gene Name: piwi-like RNA-mediated gene silencing 2
  Uniprot ID: Q8TC59
  ENSP ID: ENSP00000349208
MDPFRPSFRGQSPIHPSQCQAVRMPGCWPQASKPLDPALGRGAPAGRGHVFGKPEEPSTQRGPAQRESVGLVSMFRGLGIETVSKTPLKREMLPSGRGILGRGLSANLVRKDREELSPTFWDPKVLAAGDSKMAETSVGWSRTLGRGSSDASLLPLGRAAGGISREVDKPPCTFSTPSRGPPQLSSPPALPQSPLHSPDRPLVLTVEHKEKELIVKQGSKGTPQSLGLNLVKIQCHNEAVYQYHVTFSPNVECKSMRFGMLKDHQAVTGNVTAFDGSILYLPVKLQQVLELKSQRKTDSAEISIKIQMTKILEPCSDLCIPFYNVVFRRVMKLLDMKLVGRNFYDPTSAMVLQQHRLQIWPGYAASIRRTDGGLFLLADVSHKVIRNDCVLDVMHAIYQQNKEHFQDECTKLLVGNIVITRYNNRTYRIDDVDWNKTPKDSFTMSDGKEITFLEYYSKNYGITVKEEDQPLLIHRPSERQDNHGMLLKGEILLLPELSFMTGIPEKMKKDFRAMKDLAQQINLSPKQHHSALECLLQRIAKNEAATNELMRWGLRLQKDVHKIEGRVLPMERINLKNTSFITSQELNWVKEVTRDPSILTIPMHFWALFYPKRAMDQARELVNMLEKIAGPIGMRMSPPAWVELKDDRIETYVRTIQSTLGAEGKIQMVVCIIMGPRDDLYGAIKKLCCVQSPVPSQVVNVRTIGQPTRLRSVAQKILLQINCKLGGELWGVDIPLKQLMVIGMDVYHDPSRGMRSVVGFVASINLTLTKWYSRVVFQMPHQEIVDSLKLCLVGSLKKFYEVNHCLPEKIVVYRDGVSDGQLKTVANYEIPQLQKCFEAFENYQPKMVVFVVQKKISTNLYLAAPQNFVTPTPGTVVDHTITSCEWVDFYLLAHHVRQGCGIPTHYVCVLNTANLSPDHMQRLTFKLCHMYWNWPGTIRVPAPCKYAHKLAFLSGHILHHEPAIQLCENLFFL

SEQ ID NO: 63827 - protein, 973 aa, Homo sapiens; identical to SEQ ID NO: 63826
  Payload ID: 12736
  Gene Symbol: PIWIL2
  Gene Name: piwi-like RNA-mediated gene silencing 2
  Uniprot ID: Q8TC59
  ENSP ID: ENSP00000406956

SEQ ID NO: 63828 - protein, 937 aa, Homo sapiens
  Payload ID: 12736
  Gene Symbol: PIWIL2
  Gene Name: piwi-like RNA-mediated gene silencing 2
  Uniprot ID: Q8TC59
  ENSP ID: ENSP00000428267
MDPFRPSFRGQSPIHPSQCQAVRMPGCWPQASKPLDPALGRGAPAGRGHVFGKPEEPSTQRGPAQRESVGLVSMFRGLGIETVSKTPLKREMLPSGRGILGRGLSANLVRKDREELSPTFWDPKVLAAGDSKMAETSVGWSRTLGRGSSDASLLPLGRAAGGISREVDKPPCTFSTPSRGPPQLSSPPALPQSPLHSPDRPLVLTVEHKEKELIVKQGSKGTPQSLGLNLVKIQCHNEAVYQYHVTFSPNVECKSMRFGMLKDHQAVTGNVTAFDGSILYLPVKLQQVLELKSQRKTDSAEISIKIQMTKILEPCSDLCIPFYNVVFRRVMKLLDMKLVGRNFYDPTSAMVLQQHRLQIWPGYAASIRRTDGGLFLLADVSHKVIRNDCVLDVMHAIYQQNKEHFQDECTKLLVGNIVITRYNNRTYRIDDVDWNKTPKDSFTMSDGKEITFLEYYSKNYGITVKEEDQPLLIHRPSERQDNHGMLLKGEILLLPELSFMTGIPEKMKKDFRAMKDLAQQINLSPKQHHSALECLLQRIAKNEAATNELMRWGLRLQKDVHKIEGRVLPMERINLKNTSFITSQELNWVKEVTRDPSILTIPMHFWALFYPKRAMDQARELVNMLEKIAGPIGMRMSPPAWVELKDDRIETYVRTIQSTLGAEGKIQMVVCIIMGPRDDLYGAIKKLCCVQSPVPSQVVNVRTIGQPTRLRSVAQKILLQINCKLGGELWGVDIPLKQLMVIGMDVYHDPSRGMRSVVGFVASINLTLTKWYSRVVFQMPHQEIVDSLKLCLVGSLKKFYEVNHCLPEKIVVYRDGVSDGQLKTVANYEIPQLQKCFEAFENYQPKMVVFVVQKKISTNLYLAAPQNFVTPTPGTVVDHTITSCEWLTFKLCHMYWNWPGTIRVPAPCKYAHKLAFLSGHILHHEPAIQLCENLFFL

SEQ ID NO: 63829 - protein, 937 aa, Homo sapiens; identical to SEQ ID NO: 63828
  Payload ID: 12736
  Gene Symbol: PIWIL2
  Gene Name: piwi-like RNA-mediated gene silencing 2
  Uniprot ID: Q8TC59
  ENSP ID: ENSP00000478103

SEQ ID NO: 63830 - protein, 882 aa, Homo sapiens
  Payload ID: 12737
  Gene Symbol: PIWIL3
  Gene Name: piwi-like RNA-mediated gene silencing 3
  Uniprot ID: Q7Z3Z3
  ENSP ID: ENSP00000330031
MPGRARTRARGRARRRESYQQEAPGGPRAPGSATTQEPPQLQSTPRPLQEEVPVVRPLQPRAARGGAGGGAQSQGVKEPGPEAGLHTAPLQERRIGGVFQDLVVNTRQDMKHVKDSKTGSEGTVVQLLANHFRVISRPQWVAYKYNVDYKPDIEDGNLRTILLDQHRRKFGERHIFDGNSLLLSRPLKERRVEWLSTTKDKNIVKITVEFSKELTPTSPDCLRYYNILFRRTFKLLDFEQVGRNYYTKKKAIQLYRHGTSLEIWLGYVTSVLQYENSITLCADVSHKLLRIETAYDFIKRTSAQAQTGNIREEVTNKLIGSIVLTKYNNKTYRVDDIDWKQNPEDTFNKSDGSKITYIDYYRQQHKEIVTVKKQPLLVSQGRWKKGLTGTQREPILLIPQLCHMTGLTDEICKDYSIVKELAKHTRLSPRRRHHTLKEFINTLQDNKKVRELLQLWDLKFDTNFLSVPGRVLKNANIVQGRRMVKANSQGDWSREIRELPLLNAMPLHSWLILYSRSSHREAMSLKGHLQSVTAPMGITMKPAEMIEVDGDANSYIDTLRKYTRPTLQMGMSCLLVFKVICILPNDDKRRYDSIKRYLCTKCPIPSQCVVKKTLEKVQARTIVTKIAQQMNCKMGGALWKVETDVQRTMFVGIDCFHDIVNRQKSIAGFVASTNAELTKWYSQCVIQKTGEELVKELEICLKAALDVWCKNESSMPHSVIVYRDGVGDGQLQALLDHEAKKMSTYLKTISPNNFTLAFIVVKKRINTRFFLKHGSNFQNPPPGTVIDVELTRNEWYDFFIVSQSVQDGTVTPTHYNVIYDTIGLSPDTVQRLTYCLCHMYYNLPGIIRVPAPCHYAHKLAYLVGQSIHQEPNRSLSTRLFYL

SEQ ID NO: 63831 - protein, 764 aa, Homo sapiens
  Payload ID: 12737
  Gene Symbol: PIWIL3
  Gene Name: piwi-like RNA-mediated gene silencing 3
  ENSP ID: ENSP00000431843
MKHVKDSKTGSEGTVVQLLANHFRVISRPQWVAYKYNVDYKPDIEDGNLRTILLDQHRRKFGERHIFDGNSLLLSRPLKERRVEWLSTTKDKNIVKITVEFSKELTPTSPDCLRYYNILFRRTFKLLDFEQVGRNYYTKKKAIQLYRHGTSLEIWLGYVTSVLQYENSITLCADVSHKLLRIETAYDFIKRTSAQAQTGNIREEVTNKLIGSIVLTKYNNKTYRVDDIDWKQNPEDTFNKSDGSKITYIDYYRQQHKEIVTVKKQPLLVSQGRWKKGLTGTQREPILLIPQLCHMTGLTDEICKDYSIVKELAKHTRLSPRRRHHTLKEFINTLQDNKKVRELLQLWDLKFDTNFLSVPGRVLKNANIVQGRRMVKANSQGDWSREIRELPLLNAMPLHSWLILYSRSSHREAMSLKGHLQSVTAPMGITMKPAEMIEVDGDANSYIDTLRKYTRPTLQMVICILPNDDKRRYDSIKRYLCTKCPIPSQCVVKKTLEKVQARTIVTKIAQQMNCKMGGALWKVETDVQRTMFVGIDCFHDIVNRQKSIAGFVASTNAELTKWYSQCVIQKTGEELVKELEICLKAALDVWCKNESSMPHSVIVYRDGVGDGQLQALLDHEAKKMSTYLKTISPNNFTLAFIVVKKRINTRFFLKHGSNFQNPPPGTVIDVELTRNEWYDFFIVSQSVQDGTVTPTHYNVIYDTIGLSPDTVQRLTYCLCHMYYNLPGIIRVPAPCHYAHKLAYLVGQSIHQEPNRSLSTRLFYL

SEQ ID NO: 63832 - protein, 764 aa, Homo sapiens; identical to SEQ ID NO: 63831
  Payload ID: 12737
  Gene Symbol: PIWIL3
  Gene Name: piwi-like RNA-mediated gene silencing 3
  ENSP ID: ENSP00000435718

SEQ ID NO: 63833 - protein, 882 aa, Homo sapiens; identical to SEQ ID NO: 63830
  Payload ID: 12737
  Gene Symbol: PIWIL3
  Gene Name: piwi-like RNA-mediated gene silencing 3
  Uniprot ID: Q7Z3Z3
  ENSP ID: ENSP00000479524

SEQ ID NO: 63834 - protein, 852 aa, Homo sapiens
  Payload ID: 12738
  Gene Symbol: PIWIL4
  Gene Name: piwi-like RNA-mediated gene silencing 4
  Uniprot ID: Q7Z3Z4
  ENSP ID: ENSP00000299001
MSGRARVKARGIARSPSATEVGRIQASPLPRSVDLSNNEASSSNGFLGTSRISTNDKYGISSGDAGSTFMERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKMTITLKRELPSSSPVCIQVFNIIFRKILKKLSMYQIGRNFYNPSEPMEIPQHKLSLWPGFAISVSYFERKLLFSADVSYKVLRNETVLEFMTALCQRTGLSCFTQTCEKQLIGLIVLTRYNNRTYSIDDIDWSVKPTHTFQKRDGTEITYVDYYKQQYDITVSDLNQPMLVSLLKKKRNDNSEAQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDYPKIIKVQENPAAFVRAIQQYVDPDVQLVMCILPSNQKTYYDSIKKYLSSDCPVPSQCVLARTLNKQGMMMSIATKIAMQMTCKLGGELWAVEIPLKSLMVVGIDVCKDALSKDVMVVGCVASVNPRITRWFSRCILQRTMTDVADCLKVFMTGALNKWYKYNHDLPARIIVYRAGVGDGQLKTLIEYEVPQLLSSVAESSSNTSSRLSVIVVRKKCMPRFFTEMNRTVQNPPLGTVVDSEATRNEWYDFYLISQVACRGTVSPTYYNVIYDDNGLKPDHMQRLTFKLCHLYYNWPGIVSVPAPCQYAHKLTFLVAQSIHKEPSLELANHLFYL

SEQ ID NO: 63835 - protein, 495 aa, Homo sapiens
  Payload ID: 12738
  Gene Symbol: PIWIL4
  Gene Name: piwi-like RNA-mediated gene silencing 4
  Uniprot ID: Q7Z3Z4
  ENSP ID: ENSP00000413838
MGPRSVDLSNNEASSSNGFLGTSRISTNDKYGISSGDAGSTFMERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKMTITLKRELPSSSPVCIQVFNIIFRKILKKLSMYQIGRNFYNPSEPMEIPQHKLSLWPGFAISVSYFERKLLFSADVSYKVLRNETVLEFMTALCQRTGLSCFTQTCEKQLIGLIVLTRYNNRTYSIDDIDWSVKPTHTFQKRDGTEITYVDYYKQQYDITVSDLNQPMLVSLLKKKRNDNSEAQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDYPKM

SEQ ID NO: 63836 - protein, 203 aa, Homo sapiens
  Payload ID: 12738
  Gene Symbol: PIWIL4
  Gene Name: piwi-like RNA-mediated gene silencing 4
  ENSP ID: ENSP00000439710
MGMLFFVGIRKVILFLLTPNSAGALNKWYKYNHDLPARIIVYRAGVGDGQLKTLIEYEVPQLLSSVAESSSNTSSRLSVIVVRKKCMPRFFTEMNRTVQNPPLGTVVDSEATRNEWYDFYLISQVACRGTVSPTYYNVIYDDNGLKPDHMQRLTFKLCHLYYNWPGIVSVPAPCQYAHKLTFLVAQSIHKEPSLELANHLFYL

SEQ ID NO: 63837 - protein, 118 aa, Homo sapiens
  Payload ID: 12738
  Gene Symbol: PIWIL4
  Gene Name: piwi-like RNA-mediated gene silencing 4
  ENSP ID: ENSP00000440499
MERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKM

SEQ ID NO: 63838 - protein, 453 aa, Homo sapiens
  Payload ID: 12738
  Gene Symbol: PIWIL4
  Gene Name: piwi-like RNA-mediated gene silencing 4
  Uniprot ID: Q7Z3Z4
  ENSP ID: ENSP00000444575
MERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKMTITLKRELPSSSPVCIQVFNIIFRKILKKLSMYQIGRNFYNPSEPMEIPQHKLSLWPGFAISVSYFERKLLFSADVSYKVLRNETVLEFMTALCQRTGLSCFTQTCEKQLIGLIVLTRYNNRTYSIDDIDWSVKPTHTFQKRDGTEITYVDYYKQQYDITVSDLNQPMLVSLLKKKRNDNSEAQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDYPKM

SEQ ID NO: 63839 - protein, 177 aa, Homo sapiens
  Payload ID: 12739
  Gene Symbol: PLAC8L1
  Gene Name: PLAC8-like 1
  Uniprot ID: A1L4L8
  ENSP ID: ENSP00000309087
MNWFGSNFFRCPEDLSLLNIYSPLLSHMSSEDEHFISNLRGHVPASAVVKQPVRGASGRTTITAIVQTGGGWSTGLFSVCRDRRICFCGLFCPMCLECDIARHYGECLCWPLLPGSTFALRIGTRERHKIQGTLCEDWLAVHCCWAFSICQVARELKMRTSQVYEICAVPMTKDTLV

SEQ ID NO: 63840 - protein, 86 aa, Homo sapiens
  Payload ID: 12739
  Gene Symbol: PLAC8L1
  Gene Name: PLAC8-like 1
  ENSP ID: ENSP00000423992
MNWFGSNFFRCPEDLSLLNIYSPLLSHMSSEDEHFISNLRGHVPASAVVKQPVRGASGRTTITAIVQTGGGWSTGLFSVCRDRRIL

SEQ ID NO: 63841 - protein, 207 aa, Homo sapiens
  Payload ID: 12740
  Gene Symbol: PLET1
  Gene Name: placenta expressed transcript 1
  Uniprot ID: Q6UQ28
  ENSP ID: ENSP00000341412
MAVFHDMLLQPLGMFLCLSLQLSSATFIRYSSTCFTFDEYYTITLDIKASSHIYESNAVYSVFVPVNDSVYAVVMKTLDENSDSAGLWQRADKNCYSNSTYYVKDQYMTVLEAQWQAPEPENITEVEIQAFTVQIRALPILSTLKLREKLSTLALAAKIPQSSAFKPFFMITPKSIRLEGLANQVFSSPITEAIYILLAFLTSTLLF

SEQ ID NO: 63842 - protein, 169 aa, Homo sapiens
  Payload ID: 12741
  Gene Symbol: PGF
  Gene Name: placental growth factor
  ENSP ID: ENSP00000238607
MPVMRLFPCFLQLLAGLALPAVPPQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 63843 - protein, 221 aa, Homo sapiens
  Payload ID: 12741
  Gene Symbol: PGF
  Gene Name: placental growth factor
  Uniprot ID: P49763
  ENSP ID: ENSP00000385365
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRHSPGRQSPDMPGDFRADAPSFLPPRRSLPMLFRMEWGCALTGSQSAVWPSSPVPEEIPRMHPGRNGKKQQRKPLREKMKPERCGDAVPRR

SEQ ID NO: 63844 - protein, 170 aa, Homo sapiens
  Payload ID: 12741
  Gene Symbol: PGF
  Gene Name: placental growth factor
  Uniprot ID: P49763
  ENSP ID: ENSP00000451040
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 63845 - protein, 149 aa, Homo sapiens
  Payload ID: 12741
  Gene Symbol: PGF
  Gene Name: placental growth factor
  Uniprot ID: P49763
  ENSP ID: ENSP00000451413
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERCGDAVPRR

SEQ ID NO: 63846 - protein, 212 aa, Homo sapiens
  Payload ID: 12742
  Gene Symbol: PLAC1
  Gene Name: placenta-specific 1
  Uniprot ID: Q9HBJ0
  ENSP ID: ENSP00000352173
MKVFKFIGLMILLTSAFSAGSGQSPMTVLCSIDWFMVTVHPFMLNNDVCVHFHELHLGLGCPPNHVQPHAYQFTYRVTECGIRAKAVSQDMVIYSTEIHYSSKGTPSKFVIPVSCAAPQKSPWLTKPCSMRVASKSRATAQKDEKCYEVFSLSQSSQRPNCDCPPCVFSEEEHTQVPCHQAGAQEAQPLQPSHFLDISEDWSLHTDDMIGSM

SEQ ID NO: 63847 - protein, 115 aa, Homo sapiens
  Payload ID: 12743
  Gene Symbol: PLAC8
  Gene Name: placenta-specific 8
  Uniprot ID: Q9NZF1
  ENSP ID: ENSP00000309509
MQAQAPVVVVTQPGVGPGPAPQNSNWQTGMCDCFSDCGVCLCGTFCFPCLGCQVAADMNECCLCGTSVAMRTLYRTRYGIPGSICDDYMATLCCPHCTLCQIKRDINRRRAMRTF

SEQ ID NO: 63848 - protein, 115 aa, Homo sapiens; identical to SEQ ID NO: 63847
  Payload ID: 12743
  Gene Symbol: PLAC8
  Gene Name: placenta-specific 8
  Uniprot ID: Q9NZF1
  ENSP ID: ENSP00000399700

SEQ ID NO: 63849 - protein, 115 aa, Homo sapiens; identical to SEQ ID NO: 63847
  Payload ID: 12743
  Gene Symbol: PLAC8
  Gene Name: placenta-specific 8
  Uniprot ID: Q9NZF1
  ENSP ID: ENSP00000412230

SEQ ID NO: 63850 - protein, 115 aa, Homo sapiens; identical to SEQ ID NO: 63847
  Payload ID: 12743
  Gene Symbol: PLAC8
  Gene Name: placenta-specific 8
  Uniprot ID: Q9NZF1
  ENSP ID: ENSP00000422526

SEQ ID NO: 63851 - protein, 58 aa, Homo sapiens
  Payload ID: 12743
  Gene Symbol: PLAC8
  Gene Name: placenta-specific 8
  ENSP ID: ENSP00000423459
MNECCLCGTSVAMRTLYRTRYGIPGSICDDYMATLCCPHCTLCQIKRDINRRRAMRTF

SEQ ID NO: 63852 - protein, 97 aa, Homo sapiens
  Payload ID: 12744
  Gene Symbol: PLAC9
  Gene Name: placenta-specific 9
  Uniprot ID: Q5JTB6
  ENSP ID: ENSP00000361337
MRPLLCALTGLALLRAAGSLAAAEPFSPPRGDSAQSTACDRHMAVQRRLDVMEEMVEKTVDHLGTEVKGLLGLLEELAWNLPPGPFSPAPDLLGDGF

SEQ ID NO: 63853 - protein, 87 aa, Homo sapiens
  Payload ID: 12744
  Gene Symbol: PLAC9
  Gene Name: placenta-specific 9
  ENSP ID: ENSP00000361341
MRPLLCALTGLALLRAAGSLAAAEPFSPPRGDSAQSTACDRHMAVQRRLDVMEEMASEPWSWSPAVGGGAPARQRPQNQPCPLDFLP

SEQ ID NO: 63854 - protein, 55 aa, Homo sapiens
  Payload ID: 12744
  Gene Symbol: PLAC9
  Gene Name: placenta-specific 9
  ENSP ID: ENSP00000361344
MAVQRRLDVMEEMVEKTVDHLGTEVKGLLGLLEELAWNLPPGPFSPAPDLLGDGF

SEQ ID NO: 63855 - protein, 747 aa, Homo sapiens
  Payload ID: 12745
  Gene Symbol: PKP1
  Gene Name: plakophilin 1
  Uniprot ID: Q13835
  ENSP ID: ENSP00000263946
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRKRLGMRELLALVPQRATSSRVNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 63856 - protein, 747 aa, Homo sapiens; identical to SEQ ID NO: 63855
  Payload ID: 12745
  Gene Symbol: PKP1
  Gene Name: plakophilin 1
  Uniprot ID: Q13835
  ENSP ID: ENSP00000295597

SEQ ID NO: 63857 - protein, 726 aa, Homo sapiens
  Payload ID: 12745
  Gene Symbol: PKP1
  Gene Name: plakophilin 1
  Uniprot ID: Q13835
  ENSP ID: ENSP00000356293
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 63858 - protein, 725 aa, Homo sapiens
  Payload ID: 12745
  Gene Symbol: PKP1
  Gene Name: plakophilin 1
  ENSP ID: ENSP00000482213
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIRHLLQQDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 63859 - protein, 881 aa, Homo sapiens
  Payload ID: 12746
  Gene Symbol: PKP2
  Gene Name: plakophilin 2
  Uniprot ID: Q99959
  ENSP ID: ENSP00000070846
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMLPSRISAAATFIQHECFQKSEARKRVNQLRGILKLLQLLKVQNEDVQRAVCGALRNLVFEDNDNKLEVAELNGVPRLLQVLKQTRDLETKKQITDHTVNLRSRNGWPGAVAHACNPSTLGGQGGRITRSGVRDQPDQHGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKAQFKKTDFVNSRTAKAYHSLKD

SEQ ID NO: 63860 - protein, 837 aa, Homo sapiens
  Payload ID: 12746
  Gene Symbol: PKP2
  Gene Name: plakophilin 2
  Uniprot ID: Q99959
  ENSP ID: ENSP00000342800
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMLPSRISAAATFIQHECFQKSEARKRVNQLRGILKLLQLLKVQNEDVQRAVCGALRNLVFEDNDNKLEVAELNGVPRLLQVLKQTRDLETKKQITGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKAQFKKTDFVNSRTAKAYHSLKD

SEQ ID NO: 63861 - protein, 824 aa, Homo sapiens [sequence omitted]

SEQ ID NO: 63862 - protein, 36 aa, Homo sapiens
  Payload ID: 12746
  Gene Symbol: PKP2
  Gene Name: plakophilin 2
  ENSP ID: ENSP00000481383
  MOD_RES (1)..(1): Any amino acid
XGRGGQTVKSLRIQEQVQQTLARKGRSSVGNGPVLN

SEQ ID NO: 63863 - protein, 797 aa, Homo sapiens
  Payload ID: 12747
  Gene Symbol: PKP3
  Gene Name: plakophilin 3
  Uniprot ID: Q9Y446
  ENSP ID: ENSP00000331678
MQDGNFLLSALQPEAGVCSLALPSDLQLDRRGAEGPEAERLRAARVQEQVRARLLQLGQQPRHNGAAEPEPEAETARGTSRGQYHTLQAGFSSRSQGLSGDKTSGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRLSSGFDDIDLPSAVKYLMASDPNLQVLGAAYIQHKCYSDAAAKKQARSLQAVPRLVKLFNHANQEVQRHATGAMRNLIYDNADNKLALVEENGIFELLRTLREQDDELRKNVTGILWNLSSSDHLKDRLARDTLEQLTDLVLSPLSGAGGPPLIQQNASEAEIFYNATGFLRNLSSASQATRQKMRECHGLVDALVTSINHALDAGKCEDKSVENAVCVLRNLSYRLYDEMPPSALQRLEGRGRRDLAGAPPGEVVGCFTPQSRRLRELPLAADALTFAEVSKDPKGLEWLWSPQIVGLYNRLLQRCELNRHTTEAAAGALQNITAGDRRWAGVLSRLALEQERILNPLLDRVRTADHHQLRSLTGLIRNLSRNARNKDEMSTKVVSHLIEKLPGSVGEKSPPAEVLVNIIAVLNNLVVASPIAARDLLYFDGLRKLIFIKKKRDSPDSEKSSRAASSLLANLWQYNKLHRDFRAKGYRKEDFLGP

SEQ ID NO: 63864 - protein, 156 aa, Homo sapiens
  Payload ID: 12747
  Gene Symbol: PKP3
  Gene Name: plakophilin 3
  ENSP ID: ENSP00000434110
MPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRL

SEQ ID NO: 63865 - protein, 247 aa, Homo sapiens
  Payload ID: 12747
  Gene Symbol: PKP3
  Gene Name: plakophilin 3
  ENSP ID: ENSP00000434517
MESWTPRPSAVASGMSWEAGGIRTTSRPEAGVCSLALPSDLQLDRRGAEGPEAERLRAARVQEQVRARLLQLGQQPRHNGAAEPEPEAETARGTSRGQYHTLQAGFSSRSQGLSGDKTSGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWP

SEQ ID NO: 63866 - protein, 197 aa, Homo sapiens
  Payload ID: 12747
  Gene Symbol: PKP3
  Gene Name: plakophilin 3
  ENSP ID: ENSP00000435383
MPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRLSSGFDDIDLPSAVKYLMASDPNLQVLGAAYIQHKCYSDAAA

SEQ ID NO: 63867 - protein, 212 aa, Homo sapiens
  Payload ID: 12747
  Gene Symbol: PKP3
  Gene Name: plakophilin 3
  ENSP ID: ENSP00000435478
MQDGNFLLSALQPEAETARGTSRGQYHTLQAGFSSRSQGLSGDKTSGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGA

SEQ ID NO: 63868 - protein, 120 aa, Homo sapiens
  Payload ID: 12747
  Gene Symbol: PKP3
  Gene Name: plakophilin 3
  ENSP ID: ENSP00000435522
MPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVA

SEQ ID NO: 63869 - protein, 115 aa, Homo sapiens
  Payload ID: 12747
  Gene Symbol: PKP3
  Gene Name: plakophilin 3
  ENSP ID: ENSP00000436847
  MOD_RES (1)..(1): Any amino acid
XFDGLRKLIFIKKKRDSPDSEKSSRAASSLLANLWQYNKLHRDFRAVRFPSPGQAGTRVQGMGRRGRVSEEAHGRMETRDPERKGPGHTQHTAGGTAGRGPHGQTCTLTLGLSPL

SEQ ID NO: 63870 - protein, 1149 aa, Homo sapiens
  Payload ID: 12748
  Gene Symbol: PKP4
  Gene Name: plakophilin 4
  Uniprot ID: Q99569
  ENSP ID: ENSP00000374407
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSVGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSGSSKPSPIYISSYSSPAREQNRRLQHQQLYYSQDDSNRKNFDAYRLYLQSPHSYEDPYFDDRVHFPASTDYSTQYGLKSTTNYVDFYSTKRPSYRAEQYPGSPDSWV

SEQ ID NO: 63871 - protein, 1192 aa, Homo sapiens
  Payload ID: 12748
  Gene Symbol: PKP4
  Gene Name: plakophilin 4
  Uniprot ID: Q99569
  ENSP ID: ENSP00000374409
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSVGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSVGSTSSSPALLGIRDPRSEYDRTQPPMQYYNSQGDATHKGLYPGSSKPSPIYISSYSSPAREQNRRLQHQQLYYSQDDSNRKNFDAYRLYLQSPHSYEDPYFDDRVHFPASTDYSTQYGLKSTTNYVDFYSTKRPSYRAEQYPGSPDSWV

SEQ ID NO: 63872 - protein, 53 aa, Homo sapiens
  Payload ID: 12748
  Gene Symbol: PKP4
  Gene Name: plakophilin 4
  ENSP ID: ENSP00000391658
MPAPEQASLVEEGQPQTRQEAASTGPGMEPETTATTILASVKEQVFTSLSTLG

SEQ ID NO: 63873 - protein, 95 aa, Homo sapiens
  Payload ID: 12748
  Gene Symbol: PKP4
  Gene Name: plakophilin 4
  ENSP ID: ENSP00000392515
MPAPEQASLVEEGQPQTRQEAASTGPGMEPETTATTILASVKEQELQFQRLTRELEVERQIVASQLERCRLGAESPSIASTSILCYSWAKKLLSE

SEQ ID NO: 63874 - protein, 216 aa, Homo sapiens
  Payload ID: 12748
  Gene Symbol: PKP4
  Gene Name: plakophilin 4
  ENSP ID: ENSP00000393872
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQHRRVSFKGVSENFSG

SEQ ID NO: 63875 - protein, 216 aa, Homo sapiens; identical to SEQ ID NO: 63874
  Payload ID: 12748
  Gene Symbol: PKP4
  Gene Name: plakophilin 4
  ENSP ID: ENSP00000396827

SEQ ID NO: 63876 - protein, 46 aa, Homo sapiens
  Payload ID: 12748
  Gene Symbol: PKP4
  Gene Name: plakophilin 4
  ENSP ID: ENSP00000407218
MPAPEQASLVEEGQPQTRQEAASTGPGMEPETTATTILASVKEQLN

SEQ ID NO: 63877 - protein, 166 aa, Homo sapiens
  Payload ID: 12748
  Gene Symbol: PKP4
  Gene Name: plakophilin 4
  ENSP ID: ENSP00000437815
  MOD_RES (1)..(1): Any amino acid
XCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQLYGGLGQSPPGRPPIPTDQPLNTKPPPEWGPH

SEQ ID NO: 63878 - protein, 1208 aa, Homo sapiens
  Payload ID: 12748
  Gene Symbol: PKP4
  Gene Name: plakophilin 4
  ENSP ID: ENSP00000486320
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRGRPKRKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSVGSTSSSPALLGIRDPRSEYDRTQPPMQYYNSQGDATHKGLYPGSSKPSPIYISSYSSPAREQNRRLQHQQLYYSQDDSNRKNFDAYRLYLQSPHSYEDPYFDDRVHFPASTDYSTQYGLKSTTNYVDFYSTKRPSYRAEQYPGSPDSWVHQDAQQRNSFFLTLFRLR

SEQ ID NO: 63879 - protein, 53 aa, Homo sapiens; identical to SEQ ID NO: 63872
  Payload ID: 12748
  Gene Symbol: PKP4
  Gene Name: plakophilin 4
  ENSP ID: ENSP00000486877

SEQ ID NO: 63880 - protein, 442 aa, Homo sapiens
  Payload ID: 12749
  Gene Symbol: PLVAP
  Gene Name: plasmalemma vesicle associated protein
  Uniprot ID: Q9BX97
  ENSP ID: ENSP00000252590
MGLAMEHGGSYARAGGSSRGCWYYLRYFFLFVSLIQFLIILGLVLFMVYGNVHVSTESNLQATERRAEGLYSQLLGLTASQSNLTKELNFTTRAKDAIMQMWLNARRDLDRINASFRQCQGDRVIYTNNQRYMAAIILSEKQCRDQFKDMNKSCDALLFMLNQKVKTLEVEIAKEKTICTKDKESVLLNKRVAEEQLVECVKTRELQHQERQLAKEQLQKVQALCLPLDKDKFEMDLRNLWRDSIIPRSLDNLGYNLYHPLGSELASIRRACDHMPSLMSSKVEELARSLRADIERVARENSDLQRQKLEAQQGLRASQEAKQKVEKEAQAREAKLQAECSRQTQLALEEKAVLRKERDNLAKELEEKKREAEQLRMELAIRNSALDTCIKTKSQPMMPVSRPMGPVPNPQPIDPASLEEFKRKILESQRPPAGIPVAPSSG

SEQ ID NO: 63881 - protein, 53 aa, Homo sapiens
  Payload ID: 12749
  Gene Symbol: PLVAP
  Gene Name: plasmalemma vesicle associated protein
  ENSP ID: ENSP00000469369
  MOD_RES (1)..(1): Any amino acid
XSEKQCRDQFKDMNKSCDALLFMLNQKVRTGSHSPPLLERECFQDPLGALSRG

SEQ ID NO: 63882 - protein, 188 aa, Homo sapiens
  Payload ID: 12749
  Gene Symbol: PLVAP
  Gene Name: plasmalemma vesicle associated protein
  ENSP ID: ENSP00000472928
MGLAMEHGGSYARAGGSSRGCWYYLRYFFLFVSLIQFLIILGLVLFMVYGNVHVSTESNLQATERRAEGLYSQLLGLTASQSNLTKELNFTTRAKDAIMQMWLNARRDLDRINASFRQCQGDRVIYTNNQRYMAAIILSEKQCRDQFKDMNKSCDALLFMLNQKVKTLEVEIAKLQAECSRQTQLALE

SEQ ID NO: 63883 - protein, 810 aa, Homo sapiens
  Payload ID: 12750
  Gene Symbol: PLG
  Gene Name: plasminogen
  Uniprot ID: P00747
  ENSP ID: ENSP00000308938
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 63884 - protein, 136 aa, Homo sapiens
  Payload ID: 12750
  Gene Symbol: PLG
  Gene Name: plasminogen
  ENSP ID: ENSP00000355891
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPR

SEQ ID NO: 63885 - protein, 166 aa, Homo sapiens
  Payload ID: 12750
  Gene Symbol: PLG
  Gene Name: plasminogen
  ENSP ID: ENSP00000389424
MEHKEVVLLLLLFLKSGQGEPLDDYVNTQGASLFSVTKKQLGAGSIEECAAKCEEDEEFTCRYFHCRCTYAGICNSDGKAFQYHSKEQQCVIMAENRKSSIIIRMRDVVLFEKKVYLSECKTGNGKNYRGTMSKTKNGITCQKWSSTSPHRPRFSPATHPSEGLEE

SEQ ID NO: 63886 - protein, 562 aa, Homo sapiens
  Payload ID: 12751
  Gene Symbol: PLAT
  Gene Name: plasminogen activator, tissue
  Uniprot ID: P00750
  ENSP ID: ENSP00000220809
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 63887 - protein, 516 aa, Homo sapiens
  Payload ID: 12751
  Gene Symbol: PLAT
  Gene Name: plasminogen activator, tissue
  Uniprot ID: P00750
  ENSP ID: ENSP00000270188
MDAMKRGLCCVLLLCGAVFVSPSQEIHARFRRGARSYQGCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 63888 - protein, 562 aa, Homo sapiens; identical to SEQ ID NO: 63886
  Payload ID: 12751
  Gene Symbol: PLAT
  Gene Name: plasminogen activator, tissue
  Uniprot ID: P00750
  ENSP ID: ENSP00000392045

SEQ ID NO: 63889 - protein, 436 aa, Homo sapiens
  Payload ID: 12751
  Gene Symbol: PLAT
  Gene Name: plasminogen activator, tissue
  ENSP ID: ENSP00000407861
MDAMKRGLCCVLLLCGAVFVSPSQEIHARFRRGARSYQVICRDEKTQMIYQQHQSWLRPVLRSNRVEYCWCNSGRAQCHSVPVKRNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 63890 - protein, 178 aa, Homo sapiens
  Payload ID: 12751
  Gene Symbol: PLAT
  Gene Name: plasminogen activator, tissue
  ENSP ID: ENSP00000428797
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNY

SEQ ID NO: 63891 - protein, 499 aa, Homo sapiens
  Payload ID: 12751
  Gene Symbol: PLAT
  Gene Name: plasminogen activator, tissue
  ENSP ID: ENSP00000428886
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 63892 - protein, 473 aa, Homo sapiens
  Payload ID: 12751
  Gene Symbol: PLAT
  Gene Name: plasminogen activator, tissue
  ENSP ID: ENSP00000429401
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 63893 - protein, 96 aa, Homo sapiens
  Payload ID: 12751
  Gene Symbol: PLAT
  Gene Name: plasminogen activator, tissue
  ENSP ID: ENSP00000429542
  MOD_RES (1)..(1): Any amino acid
XFAGKCCEIDTRATCYEDQGISYRGTWSTAESGAECTNWNSSALAQKPYSGRRPDAIRLGLGNHNYCRTPVPRHWAWANIITAGILMGMPSPGATC

SEQ ID NO: 63894 - protein, 157 aa, Homo sapiens
  Payload ID: 12751
  Gene Symbol: PLAT
  Gene Name: plasminogen activator, tissue
  ENSP ID: ENSP00000429801
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALA

SEQ ID NO: 63895 - protein, 431 aa, Homo sapiens
  Payload ID: 12752
  Gene Symbol: PLAU
  Gene Name: plasminogen activator, urokinase
  Uniprot ID: P00749
  ENSP ID: ENSP00000361850
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKLLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 63896 - protein, 414 aa, Homo sapiens
  Payload ID: 12752
  Gene Symbol: PLAU
  Gene Name: plasminogen activator, urokinase
  ENSP ID: ENSP00000388474
MVFHLRTRYEQANCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKLLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 63897 - protein, 106 aa, Homo sapiens
  Payload ID: 12752
  Gene Symbol: PLAU
  Gene Name: plasminogen activator, urokinase
  ENSP ID: ENSP00000474318
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHA

SEQ ID NO: 63898 - protein, 290 aa, Homo sapiens
  Payload ID: 12753
  Gene Symbol: PLAUR
  Gene Name: plasminogen activator, urokinase receptor
  Uniprot ID: Q03405
  ENSP ID: ENSP00000221264
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEVLELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 63899 - protein, 335 aa, Homo sapiens
  Payload ID: 12753
  Gene Symbol: PLAUR
  Gene Name: plasminogen activator, urokinase receptor
  Uniprot ID: Q03405
  ENSP ID: ENSP00000339328
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 63900 - protein, 281 aa, Homo sapiens
  Payload ID: 12753
  Gene Symbol: PLAUR
  Gene Name: plasminogen activator, urokinase receptor
  Uniprot ID: Q03405
  ENSP ID: ENSP00000342049
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHERSLWGSWLPCKSTTALRPPCCEEAQATHV

SEQ ID NO: 63901 - protein, 78 aa, Homo sapiens
  Payload ID: 12753
  Gene Symbol: PLAUR
  Gene Name: plasminogen activator, urokinase receptor
  ENSP ID: ENSP00000468863
MDGAWRLASWGLRCMQCKTNGDCRVEECALGQDLCRTTIVRLWEEGEELELVEKSCTHSEKTNRTLSYRTGLKITSLT

SEQ ID NO: 63902 - protein, 226 aa, Homo sapiens
  Payload ID: 12753
  Gene Symbol: PLAUR
  Gene Name: plasminogen activator, urokinase receptor
  ENSP ID: ENSP00000470029
MQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTH

SEQ ID NO: 63903 - protein, 133 aa, Homo sapiens
  Payload ID: 12753
  Gene Symbol: PLAUR
  Gene Name: plasminogen activator, urokinase receptor
  ENSP ID: ENSP00000470050
  MOD_RES (1)..(1): Any amino acid
XRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGTLLWT

SEQ ID NO: 63904 - protein, 152 aa, Homo sapiens
  Payload ID: 12753
  Gene Symbol: PLAUR
  Gene Name: plasminogen activator, urokinase receptor
  ENSP ID: ENSP00000471241
MQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPG

SEQ ID NO: 63905 - protein, 46 aa, Homo sapiens
  Payload ID: 12753
  Gene Symbol: PLAUR
  Gene Name: plasminogen activator, urokinase receptor
  ENSP ID: ENSP00000471307
MGHPPLLPLLLLLHTCVPAWATARDSISKKKKRKKKERRNLRRYNL

SEQ ID NO: 63906 - protein, 185 aa, Homo sapiens
  Payload ID: 12753
  Gene Symbol: PLAUR
  Gene Name: plasminogen activator, urokinase receptor
  ENSP ID: ENSP00000471525
  MOD_RES (1)..(1): Any amino acid
XSWGLRCMQCKTNGDCRVEECALGQDLCRTTIVRLWEGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTH

SEQ ID NO: 63907 - protein, 286 aa, Homo sapiens
  Payload ID: 12753
  Gene Symbol: PLAUR
  Gene Name: plasminogen activator, urokinase receptor
  ENSP ID: ENSP00000471881
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPKPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 63908 - protein, 152 aa, Homo sapiens
  Payload ID: 12753
  Gene Symbol: PLAUR
  Gene Name: plasminogen activator, urokinase receptor
  ENSP ID: ENSP00000472511
MDTNLNGRGLETWSSWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEE

SEQ ID NO: 63909 - protein, 154 aa, Homo sapiens
  Payload ID: 12753
  Gene Symbol: PLAUR
  Gene Name: plasminogen activator, urokinase receptor
  ENSP ID: ENSP00000473055
  MOD_RES (1)..(1): Any amino acid
XCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHGCGHFCHGKVEFRLGAVAEACTLSTLGG

SEQ ID NO: 63910 - protein, 147 aa, Homo sapiens
  Payload ID: 12754
  Gene Symbol: PLGRKT
  Gene Name: plasminogen receptor, C-terminal lysine transmembrane protein
  Uniprot ID: Q9HBL7
  ENSP ID: ENSP00000223864
MGFIFSKSMNESMKNQKEFMLMNARLQLERQLIMQSEMRERQMAMQIAWSREFLKYFGTFFGLAAISLTAGAIKKKKPAFLVPIVPLSFILTYQYDLGYGTLLERMKGEAEDILETEKSKLQLPRGMITFESIEKARKEQSRFFIDK

SEQ ID NO: 63911 - protein, 96 aa, Homo sapiens
  Payload ID: 12755
  Gene Symbol: PLGLB1
  Gene Name: plasminogen-like B1
  Uniprot ID: Q02325
  ENSP ID: ENSP00000347933
MEHKEVVLLLLLFLKSGQGEPLDDYVNTQGPSLFSVTKKQLGAGSREECAAKCEEDKEFTCRAFQYHSKEQQCVIMAENRKSSIIIRMRDAVLFEK

SEQ ID NO: 63912 - protein, 96 aa, Homo sapiens; identical to SEQ ID NO: 63911
  Payload ID: 12755
  Gene Symbol: PLGLB1
  Gene Name: plasminogen-like B1
  Uniprot ID: Q02325
  ENSP ID: ENSP00000386505

SEQ ID NO: 63913 - protein, 96 aa, Homo sapiens; identical to SEQ ID NO: 63911
  Payload ID: 12755
  Gene Symbol: PLGLB1
  Gene Name: plasminogen-like B1
  Uniprot ID: Q02325
  ENSP ID: ENSP00000386975

SEQ ID NO: 63914 - protein, 89 aa, Homo sapiens
  Payload ID: 12755
  Gene Symbol: PLGLB1
  Gene Name: plasminogen-like B1
  ENSP ID: ENSP00000387083
MEHKEVVLLLLLFLKSGQGEPLDDYVNTQGPSLFSVTKKQLGAGSREECAAKCEEDKEFTCRYFHRRCTYPEICNSDGHSNITVKSNNV

SEQ ID NO: 63915 - protein, 96 aa, Homo sapiens; identical to SEQ ID NO: 63911
  Payload ID: 12756
  Gene Symbol: PLGLB2
  Gene Name: plasminogen-like B2
  Uniprot ID: Q02325
  ENSP ID: ENSP00000352458

SEQ ID NO: 63916 - protein, 96 aa, Homo sapiens; identical to SEQ ID NO: 63911
  Payload ID: 12756
  Gene Symbol: PLGLB2
  Gene Name: plasminogen-like B2
  Uniprot ID: Q02325
  ENSP ID: ENSP00000386317

SEQ ID NO: 63917 - protein, 182 aa, Homo sapiens
  Payload ID: 12757
  Gene Symbol: PLLP
  Gene Name: plasmolipin
  Uniprot ID: Q9Y342
  ENSP ID: ENSP00000219207
MAEFPSKVSTRTSSPAQGAEASVSALRPDLGFVRSRLGALMLLQLVLGLLVWALIADTPYHLYPAYGWVMFVAVFLWLVTIVLFNLYLFQLHMKLYMVPWPLVLMIFNISATVLYITAFIACSAAVDLTSLRGTRPYNQRAAASFFACLVMIAYGVSAFFSYQAWRGVGSNAATSQMAGGYA

SEQ ID NO: 63918 - protein, 124 aa, Homo sapiens
  Payload ID: 12757
  Gene Symbol: PLLP
  Gene Name: plasmolipin
  ENSP ID: ENSP00000454656
MAEFPSKVSTRTSSPAQGAEASVSALRPDLGFVRSRLGALMLLQLLMIFNISATVLYITAFIACSAAVDLTSLRGTRPYNQRAAASFFACLVMIAYGVSAFFSYQAWRGVGSNAATSQMAGGYA

SEQ ID NO: 63919 - protein, 91 aa, Homo sapiens
  Payload ID: 12757
  Gene Symbol: PLLP
  Gene Name: plasmolipin
  ENSP ID: ENSP00000463575
MFVAVFLWLVTIVLFNLYLFQLHMKLYMVPWPLVLMIFNISATVLYITAFIACSAAVDLTSLRGTRPYNQRAAASFFACLVMIAYGVSAFF

SEQ ID NO: 63920 - protein, 161 aa, Homo sapiens
  Payload ID: 12757
  Gene Symbol: PLLP
  Gene Name: plasmolipin
  ENSP ID: ENSP00000481720
MAEFPSKVSTRTSSPAQGAEASVSALRPDLGFVRSRLGALMLLQLVLGLLVWALIADTPYHLYPAYGWVMFVAVFLWLVTIVLFNLYLFQLHMKLYMVPWPLVLMIFNISATVLYITAFIACSAAVDLTSLRGTRPYNQRAAASVLVTSRRPQLDCRRCLL

SEQ ID NO: 63921 - protein, 629 aa, Homo sapiens
  Payload ID: 12758
  Gene Symbol: PLS1
  Gene Name: plastin 1
  Uniprot ID: Q14651
  ENSP ID: ENSP00000336831
MENSTTTISREELEELQEAFNKIDIDNSGYVSDYELQDLFKEASLPLPGYKVREIVEKILSVADSNKDGKISFEEFVSLMQELKSKDISKTFRKIINKREGITAIGGTSTISSEGTQHSYSEEEKVAFVNWINKALENDPDCKHLIPMNPNDDSLFKSLADGILLCKMINLSEPDTIDERAINKKKLTPFTISENLNLALNSASAIGCTVVNIGASDLKEGKPHLVLGLLWQIIKVGLFADIEISRNEALIALLNEGEELEELMKLSPEELLLRWVNYHLTNAGWHTISNFSQDIKDSRAYFHLLNQIAPKGGEDGPAIAIDLSGINETNDLKRAGLMLQEADKLGCKQFVTPADVVSGNPKLNLAFVANLFNTYPCLHKPNNNDIDMNLLEGESKEERTFRNWMNSLGVNPYINHLYSDLADALVIFQLYEMIRVPVNWSHVNKPPYPALGGNMKKIENCNYAVELGKNKAKFSLVGIAGQDLNEGNSTLTLALVWQLMRRYTLNVLSDLGEGEKVNDEIIIKWVNQTLKSANKKTSISSFKDKSISTSLPVLDLIDAIAPNAVRQEMIRRENLSDEDKLNNAKYAISVARKIGARIYALPDDLVEVKPKMVMTVFACLMGKGLNRIK

SEQ ID NO: 63922 - protein, 629 aa, Homo sapiens; identical to SEQ ID NO: 63921
  Payload ID: 12758
  Gene Symbol: PLS1
  Gene Name: plastin 1
  Uniprot ID: Q14651
  ENSP ID: ENSP00000387890

SEQ ID NO: 63923 - protein, 119 aa, Homo sapiens
  Payload ID: 12758
  Gene Symbol: PLS1
  Gene Name: plastin 1
  ENSP ID: ENSP00000417311
MENSTTTISREELEELQEAFNKIDIDNSGYVSDYELQDLFKEASLPLPGYKVREIVEKILSVADSNKDGKISFEEFVSLMQELKSKDISKTFRKIINKREGITAIGGTSTISSEGTQHS

SEQ ID NO: 63924 - protein, 266 aa, Homo sapiens
  Payload ID: 12758
  Gene Symbol: PLS1
  Gene Name: plastin 1
  ENSP ID: ENSP00000417481
MQELKSKDISKTFRKIINKREGITAIGGTSTISSEGTQHSYSEEEKVAFVNWINKALENDPDCKHLIPMNPNDDSLFKSLADGILLCKMINLSEPDTIDERAINKKKLTPFTISENLNLALNSASAIGCTVVNIGASDLKEGKPHLVLGLLWQIIKVGLFADIEISRNEALIALLNEGEELEELMKLSPEELLLRWVNYHLTNAGWHTISNFSQDIKDSRAYFHLLNQIAPKGGEDGPAIAIDLSGINETNDLKRAGLMLQEADKL

SEQ ID NO: 63925 - protein, 52 aa, Homo sapiens
  Payload ID: 12758
  Gene Symbol: PLS1
  Gene Name: plastin 1
  ENSP ID: ENSP00000417491
MENSTTTISREELEELQEAFNKIDIDNSGYVSDYELQDLFKEASLPLPGYKV

SEQ ID NO: 63926 - protein, 629 aa, Homo sapiens; identical to SEQ ID NO: 63921
  Payload ID: 12758
  Gene Symbol: PLS1
  Gene Name: plastin 1
  Uniprot ID: Q14651
  ENSP ID: ENSP00000418700

SEQ ID NO: 63927 - protein, 120 aa, Homo sapiens
  Payload ID: 12758
  Gene Symbol: PLS1
  Gene Name: plastin 1
  ENSP ID: ENSP00000418880
MENSTTTISREELEELQEAFNKIDIDNSGYVSDYELQDLFKEASLPLPGYKVREIVEKILSVADSNKDGKISFEEFVSLMQELKSKDISKTFRKIINKREGITAIGGTSTISSEGTQHSY

SEQ ID NO: 63928 - protein, 54 aa, Homo sapiens
  Payload ID: 12758
  Gene Symbol: PLS1
  Gene Name: plastin 1
  ENSP ID: ENSP00000419271
MENSTTTISREELEELQEAFNKIDIDNSGYVSDYELQDLFKEASLPLPGYKVRE

SEQ ID NO: 63929 - protein, 58 aa, Homo sapiens
  Payload ID: 12758
  Gene Symbol: PLS1
  Gene Name: plastin 1
  ENSP ID: ENSP00000419531
MENSTTTISREELEELQEAFNKIDIDNSGYVSDYELQDLFKEASLPLPGYKVREIVEK

SEQ ID NO: 63930 - protein, 33 aa, Homo sapiens
  Payload ID: 12758
  Gene Symbol: PLS1
  Gene Name: plastin 1
  ENSP ID: ENSP00000419893
MENSTTTISREELEELQEAFNKIDIDNSGYVSD

SEQ ID NO: 63931 - protein, 617 aa, Homo sapiens
  Payload ID: 12759
  Gene Symbol: PLS3
  Gene Name: plastin 3
  Uniprot ID: P13797
  ENSP ID: ENSP00000289290
MEDLNSNGFICDYELHELFKEANMPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKLIDFSNSVKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 63932 - protein, 630 aa, Homo sapiens
  Payload ID: 12759
  Gene Symbol: PLS3
  Gene Name: plastin 3
  Uniprot ID: P13797
  ENSP ID: ENSP00000348163
MDEMATTQISKDELDELKEAFAKVDLNSNGFICDYELHELFKEANMPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 63933 - protein, 617 aa, Homo sapiens [sequence omitted]

SEQ ID NO: 63934 - protein, 190 aa, Homo sapiens
  Payload ID: 12759
  Gene Symbol: PLS3
  Gene Name: plastin 3
  ENSP ID: ENSP00000417728
  MOD_RES (1)..(1): Any amino acid
XFKLCFVELSTQPEFMLTDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVEL

SEQ ID NO: 63935 - protein, 42 aa, Homo sapiens
  Payload ID: 12759
  Gene Symbol: PLS3
  Gene Name: plastin 3
  ENSP ID: ENSP00000419051
MDEMATTQISKDELDELKEAFAKVVETEFHRVSQDGLDLLTS

SEQ ID NO: 63936 - protein, 42 aa, Homo sapiens; identical to SEQ ID NO: 63935
  Payload ID: 12759
  Gene Symbol: PLS3
  Gene Name: plastin 3
  ENSP ID: ENSP00000420458

SEQ ID NO: 63937 - protein, 630 aa, Homo sapiens; identical to SEQ ID NO: 63932
  Payload ID: 12759
  Gene Symbol: PLS3
  Gene Name: plastin 3
  Uniprot ID: P13797
  ENSP ID: ENSP00000445339

SEQ ID NO: 63938 - protein, 164 aa, Homo sapiens
  Payload ID: 12759
  Gene Symbol: PLS3
  Gene Name: plastin 3
  ENSP ID: ENSP00000475900
MDEMATTQISKDELDELKEAFAKVDLNSNGFICDYELHELFKEANMPLPGYKVREIIQKLMLDGDRNKDGKISFDEFVYLWPKPFVLNSMFNKEEKYAFVNWINKALENDPDCRHVIPMNPNTDDLFKAVGDGIVLCKMINLSVPDTIDERAINKKKLTPFIIQ

SEQ ID NO: 63939 - protein, 42 aa, Homo sapiens; identical to SEQ ID NO: 63935
  Payload ID: 12759
  Gene Symbol: PLS3
  Gene Name: plastin 3
  ENSP ID: ENSP00000487343

SEQ ID NO: 63940 - protein, 50 aa, Homo sapiens
  Payload ID: 12760
  Gene Symbol: PDGFC
  Gene Name: platelet derived growth factor C
  ENSP ID: ENSP00000274071
MSLFGLLLLTSALAGQRQGTQAESNLSSKFQFSSNKEQNGRNYIQASGLA

SEQ ID NO: 63941 - protein, 282 aa, Homo sapiens
  Payload ID: 12760
  Gene Symbol: PDGFC
  Gene Name: platelet derived growth factor C
  Uniprot ID: Q9NRA1
  ENSP ID: ENSP00000410048
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVLQLRPKTGVRGLHKSLTDVALEHHEECDCVCRGSTGG

SEQ ID NO: 63942 - protein, 345 aa, Homo sapiens
  Payload ID: 12760
  Gene Symbol: PDGFC
  Gene Name: platelet derived growth factor C
  Uniprot ID: Q9NRA1
  ENSP ID: ENSP00000422464
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 63943 - protein, 53 aa, Homo sapiens
  Payload ID: 12760
  Gene Symbol: PDGFC
  Gene Name: platelet derived growth factor C
  ENSP ID: ENSP00000424600
  MOD_RES (1)..(1): Any amino acid
XTFDERFGLEDPEDDICKYDFVEVEEPSDGTILGRWCGSGFCIHYNIVMPNLP

SEQ ID NO: 63944 - protein, 364 aa, Homo sapiens
  Payload ID: 12761
  Gene Symbol: PDGFD
  Gene Name: platelet derived growth factor D
  Uniprot ID: Q9GZP0
  ENSP ID: ENSP00000302193
MHRLIFVYTLICANFCSCRDTSATPQSASIKALRNANLRRDDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 63945 - protein, 370 aa, Homo sapiens
  Payload ID: 12761
  Gene Symbol: PDGFD
  Gene Name: platelet derived growth factor D
  Uniprot ID: Q9GZP0
  ENSP ID: ENSP00000376865
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 63946 - protein, 206 aa, Homo sapiens
  Payload ID: 12761
  Gene Symbol: PDGFD
  Gene Name: platelet derived growth factor D
  ENSP ID: ENSP00000432909
IFEAVGAQGTVVLDEESLHVDDLDLFDGDSGLRFAEDLEVSELKVGADLEREGDLGEVPPHAVHESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNW

SEQ ID NO: 63947 - protein, 1037 aa, Homo sapiens
  Payload ID: 12762
  Gene Symbol: PEAR1
  Gene Name: platelet endothelial aggregation receptor 1
  Uniprot ID: Q5VY43
  ENSP ID: ENSP00000292357
MSPPLCPLLLLAVGLRLAGTLNPSDPNTCSFWESFTTTTKESHSRPFSLLPSEPCERPWEGPHTCPQPTVVYRTVYRQVVKTDHRQRLQCCHGFYESRGFCVPLCAQECVHGRCVAPNQCQCVPGWRGDDCSSECAPGMWGPQCDKPCSCGNNSSCDPKSGVCSCPSGLQPPNCLQPCTPGYYGPACQFRCQCHGAPCDPQTGACFCPAERTGPSCDVSCSQGTSGFFCPSTHSCQNGGVFQTPQGSCSCPPGWMGTICSLPCPEGFHGPNCSQECRCHNGGLCDRFTGQCRCAPGYTGDRCREECPVGRFGQDCAETCDCAPDARCFPANGACLCEHGFTGDRCTDRLCPDGFYGLSCQAPCTCDREHSLSCHPMNGECSCLPGWAGLHCNESCPQDTHGPGCQEHCLCLHGGVCQATSGLCQCAPGYTGPHCASLCPPDTYGVNCSARCSCENAIACSPIDGECVCKEGWQRGNCSVPCPPGTWGFSCNASCQCAHEAVCSPQTGACTCTPGWHGAHCQLPCPKGQFGEGCASRCDCDHSDGCDPVHGRCQCQAGWMGARCHLSCPEGLWGVNCSNTCTCKNGGTCLPENGNCVCAPGFRGPSCQRSCQPGRYGKRCVPCKCANHSFCHPSNGTCYCLAGWTGPDCSQPCPPGHWGENCAQTCQCHHGGTCHPQDGSCICPLGWTGHHCLEGCPLGTFGANCSQPCQCGPGEKCHPETGACVCPPGHSGAPCRIGIQEPFTVMPTTPVAYNSLGAVIGIAVLGSLVVALVALFIGYRHWQKGKEHHHLAVAYSSGRLDGSEYVMPDVPPSYSHYYSNPSYHTLSQCSPNPPPPNKVPGPLFASLQNPERPGGAQGHDNHTTLPADWKHRREPPPGPLDRGSSRLDRSYSYSYSNGPGPFYNKGLISEEELGASVASLSSENPYATIRDLPSLPGGPRESSYMEMKGPPSGSPPRQPPQFWDSQRRRQPQPQRDSGTYEQPSPLIHDRDSVGSQPPLPPGLPPGHYDSPKNSHIPGHYDLPPVRHPPSPPLRRQDR

SEQ ID NO: 63948 - protein, 1037 aa, Homo sapiens; identical to SEQ ID NO: 63947
  Payload ID: 12762
  Gene Symbol: PEAR1
  Gene Name: platelet endothelial aggregation receptor 1
  Uniprot ID: Q5VY43
  ENSP ID: ENSP00000344465

SEQ ID NO: 63949 - protein, 173 aa, Homo sapiens
  Payload ID: 12762
  Gene Symbol: PEAR1
  Gene Name: platelet endothelial aggregation receptor 1
  ENSP ID: ENSP00000389742
MSPPLCPLLLLAVGLRLAGTLNPSDPNTCSFWESFTTTTKESHSRPFSLLPSEPCERPWEGPHTCPQPTVVYRTVYRQVVKTDHRQRLQCCHGFYESRGFCVPLCAQECVHGRCVAPNQCQCVPGWRGDDCSSECAPGMWGPQCDKPCSCGNNSSCDPKSGVCSCPSGLQPPN

SEQ ID NO: 63950 - protein, 77 aa, Homo sapiens
  Payload ID: 12762
  Gene Symbol: PEAR1
  Gene Name: platelet endothelial aggregation receptor 1
  ENSP ID: ENSP00000397870
MSPPLCPLLLLAVGLRLAGTLNPSDPNTCSFWESFTTTTKESHSRPFSLLPSEPCERPWEGPHTCPQPTNSEETPGF

SEQ ID NO: 63951 - protein, 101 aa, Homo sapiens
  Payload ID: 12763
  Gene Symbol: PF4
  Gene Name: platelet factor 4
  Uniprot ID: P02776
  ENSP ID: ENSP00000296029
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 63952 - protein, 104 aa, Homo sapiens
  Payload ID: 12764
  Gene Symbol: PF4V1
  Gene Name: platelet factor 4 variant 1
  Uniprot ID: P10720
  ENSP ID: ENSP00000226524
MSSAARSRLTRATRQEMLFLALLLLPVVVAFARAEAEEDGDLQCLCVKTTSQVRPRHITSLEVIKAGPHCPTAQLIATLKNGRKICLDLQALLYKKIIKEHLES

SEQ ID NO: 63953 - protein, 230 aa, Homo sapiens
  Payload ID: 12765
  Gene Symbol: PECAM1
  Gene Name: platelet/endothelial cell adhesion molecule 1
  ENSP ID: ENSP00000455663
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVT

SEQ ID NO: 63954 - protein, 183 aa, Homo sapiens
  Payload ID: 12765
  Gene Symbol: PECAM1
  Gene Name: platelet/endothelial cell adhesion molecule 1
  ENSP ID: ENSP00000455931
MSIEASGINMFLMFLAGSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNF

SEQ ID NO: 63955 - protein, 134 aa, Homo sapiens
  Payload ID: 12765
  Gene Symbol: PECAM1
  Gene Name: platelet/endothelial cell adhesion molecule 1
  ENSP ID: ENSP00000457218
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPR

SEQ ID NO: 63956 - protein, 738 aa, Homo sapiens
  Payload ID: 12765
  Gene Symbol: PECAM1
  Gene Name: platelet/endothelial cell adhesion molecule 1
  ENSP ID: ENSP00000457421
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 63957 - protein, 175 aa, Homo sapiens
  Payload ID: 12766
  Gene Symbol: PAFAH1B2
  Gene Name: platelet-activating factor acetylhydrolase 1b, catalytic subunit 2 (30kDa)
  ENSP ID: ENSP00000304006
AAAGAGAGGGTRRSGTDGTERATDAPPADASAAWGPHGPSTSVIVVWVGTNNHENTAEEVAGGIEAIVQLINTRQPQAKIIVLGLLPRGEKPNPLRQKNAKVNQLLKVSLPKLANVQLLDTDGGFVHSDGAISCHDMFDFLHLTGGGYAKICKPLHELIMQLLEETPEEKQTTIA

SEQ ID NO: 63958 - protein, 132 aa, Homo sapiens
  Payload ID: 12766
  Gene Symbol: PAFAH1B2
  Gene Name: platelet-activating factor acetylhydrolase 1b, catalytic subunit 2 (30kDa)
  Uniprot ID: P68402
  ENSP ID: ENSP00000388742
MSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQA

SEQ ID NO: 63959 - protein, 202 aa, Homo sapiens
  Payload ID: 12766
  Gene Symbol: PAFAH1B2
  Gene Name: platelet-activating factor acetylhydrolase 1b, catalytic subunit 2 (30kDa)
  Uniprot ID: P68402
  ENSP ID: ENSP00000431365
MSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQAKIIVLGKAAASKYSISEIVRLEQGSVNWSIGTYPDDTPATTRPAILQLFTGKMSRITMKEKSRWTEEILH

SEQ ID NO: 63960 - protein, 155 aa, Homo sapiens
  Payload ID: 12766
  Gene Symbol: PAFAH1B2
  Gene Name: platelet-activating factor acetylhydrolase 1b, catalytic subunit 2 (30kDa)
  Uniprot ID: P68402
  ENSP ID: ENSP00000434951
MSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQAKIIVLIIYWQDEQDYHERKVQMD

SEQ ID NO: 63961 - protein, 229 aa, Homo sapiens
  Payload ID: 12766
  Gene Symbol: PAFAH1B2
  Gene Name: platelet-activating factor acetylhydrolase 1b, catalytic subunit 2 (30kDa)
  Uniprot ID: P68402
  ENSP ID: ENSP00000435289
MSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQAKIIVLGLLPRGEKPNPLRQKNAKVNQLLKVSLPKLANVQLLDTDGGFVHSDGAISCHDMFDFLHLTGGGYAKICKPLHELIMQLLEETPEEKQTTIA

SEQ ID NO: 63962 - protein, 231 aa, Homo sapiens
  Payload ID: 12767
  Gene Symbol: PAFAH1B3
  Gene Name: platelet-activating factor acetylhydrolase 1b, catalytic subunit 3 (29kDa)
  Uniprot ID: Q15102
  ENSP ID: ENSP00000262890
MSGEENPASKPTPVQDVQGDGRWMSLHHRFVADSKDKEPEVVFIGDSLVQLMHQCEIWRELFSPLHALNFGIGGDGTQHVLWRLENGELEHIRPKIVVVWVGTNNHGHTAEQVTGGIKAIVQLVNERQPQARVVVLGLLPRGQHPNPLREKNRQVNELVRAALAGHPRAHFLDADPGFVHSDGTISHHDMYDYLHLSRLGYTPVCRALHSLLLRLLAQDQGQGAPLLEPAP

SEQ ID NO: 63963 - protein, 231 aa, Homo sapiens; identical to SEQ ID NO: 63962
  Payload ID: 12767
  Gene Symbol: PAFAH1B3
  Gene Name: platelet-activating factor acetylhydrolase 1b, catalytic subunit 3 (29kDa)
  Uniprot ID: Q15102
  ENSP ID: ENSP00000444935

SEQ ID NO: 63964 - protein, 95 aa, Homo sapiens
  Payload ID: 12767
  Gene Symbol: PAFAH1B3
  Gene Name: platelet-activating factor acetylhydrolase 1b, catalytic subunit 3 (29kDa)
  ENSP ID: ENSP00000469352
MSGEENPASKPTPVQDVQGDGRWMSLHHRFVADSKDKEPEVVFIGDSLVQLMHQCEIWRELFSPLHALNFGIGGDGTQHVLWRLENGELEHIRPK

SEQ ID NO: 63965 - protein, 139 aa, Homo sapiens
  Payload ID: 12767
  Gene Symbol: PAFAH1B3
  Gene Name: platelet-activating factor acetylhydrolase 1b, catalytic subunit 3 (29kDa)
  ENSP ID: ENSP00000470753
MSGEENPASKPTPVQDVQGDGRWMSLHHRFVADSKDKEPEVVFIGDSLVQLMHQCEIWRELFSPLHALNFGIGGDGTQHVLWRLENGELEHIRPKIVVVWVGTNNHGHTAEQVTGGIKAIVQLGLLPRGQHPNPLREKN

SEQ ID NO: 63966 - protein, 202 aa, Homo sapiens
  Payload ID: 12767
  Gene Symbol: PAFAH1B3
  Gene Name: platelet-activating factor acetylhydrolase 1b, catalytic subunit 3 (29kDa)
  ENSP ID: ENSP00000471933
  MOD_RES (1)..(1): Any amino acid
XPASKPTPVQDVQGDGRWMSLHHRFVADSKDKEPEVVFIGDSLVQLMHQCEIWRELFSPLHALNFGIGGDGTQHVLWRLENGELEHIRPKIVVVWVGTNNHGHTAEQGLLPRGQHPNPLREKNRQVNELVRAALAGHPRAHFLDADPGFVHSDGTISHHDMYDYLHLSRLGYTPVCRALHSLLLRLLAQDQGQGAPLLEPAP

SEQ ID NO: 63967 - protein, 96 aa, Homo sapiens
  Payload ID: 12767
  Gene Symbol: PAFAH1B3
  Gene Name: platelet-activating factor acetylhydrolase 1b, catalytic subunit 3 (29kDa)
  ENSP ID: ENSP00000472950
MSGEENPASKPTPVQDVQGDGRWMSLHHRFVADSKDKEPEVVFIGDSLVQLMHQCEIWRELFSPLHALNFGIGGDGTQHVLWRLENGELEHIRPKI

SEQ ID NO: 63968 - protein, 164 aa, Homo sapiens
  Payload ID: 12767
  Gene Symbol: PAFAH1B3
  Gene Name: platelet-activating factor acetylhydrolase 1b, catalytic subunit 3 (29kDa)
  ENSP ID: ENSP00000473065
MSGEENPASKPTPVQDVQGDGRWMSLHHRFVADSKDKEPEVVFIGDSLVQLMHQCEIWRELFSPLHALNFGIGGDGTQHVLWRLENGELEHIRPKIVVVWVGTNNHGHTAEQVTGGIKAIVQLVNERQPQARVVVLGLLPRGQHPNPLREKNRQVNELVRAALA

SEQ ID NO: 63969 - protein, 410 aa, Homo sapiens
  Payload ID: 12768
  Gene Symbol: PAFAH1B1
  Gene Name: platelet-activating factor acetylhydrolase 1b, regulatory subunit 1 (45kDa)
  Uniprot ID: P43034
  ENSP ID: ENSP00000380378
MVLSQRQRDELNRAIADYLRSNGYEEAYSVFKKEAELDVNEELDKKYAGLLEKKWTSVIRLQKKVMELESKLNEAKEEFTSGGPLGQKRDPKEWIPRPPEKYALSGHRSPVTRVIFHPVFSVMVSASEDATIKVWDYETGDFERTLKGHTDSVQDISFDHSGKLLASCSADMTIKLWDFQGFECIRTMHGHDHNVSSVAIMPNGDHIVSASRDKTIKMWEVQTGYCVKTFTGHREWVRMVRPNQDGTLIASCSNDQTVRVWVVATKECKAELREHEHVVECISWAPESSYSSISEATGSETKKSGKPGPFLLSGSRDKTIKMWDVSTGMCLMTLVGHDNWVRGVLFHSGGKFILSCADDKTLRVWDYKNKRCMKTLNAHEHFVTSLDFHKTAPYVVTGSVDQTVKVWECR

SEQ ID NO: 63970 - protein, 14 aa, Homo sapiens
  Payload ID: 12768
  Gene Symbol: PAFAH1B1
  Gene Name: platelet-activating factor acetylhydrolase 1b, regulatory subunit 1 (45kDa)
  ENSP ID: ENSP00000460258
MVLSQRQRDELMKN

SEQ ID NO: 63971 - protein, 208 aa, Homo sapiens
  Payload ID: 12768
  Gene Symbol: PAFAH1B1
  Gene Name: platelet-activating factor acetylhydrolase 1b, regulatory subunit 1 (45kDa)
  ENSP ID: ENSP00000460591
SADMTIKLWDFQGFECIRTMHGHDHNVSSVAIMPNGDHIVSASRDKTIKMWEVQTGYCVKTFTGHREWVRMVRPNQDGTLIASCSNDQTVRVWVVATKECKAELREHEHVVECISWAPESSYSSISEATGSEVGHDNWVRGVLFHSGGKFILSCADDKTLRVWDYKNKRCMKTLNAHEHFVTSLDFHKTAPYVVTGSVDQTVKVWECR

SEQ ID NO: 63972 - protein, 82 aa, Homo sapiens
  Payload ID: 12768
  Gene Symbol: PAFAH1B1
  Gene Name: platelet-activating factor acetylhydrolase 1b, regulatory subunit 1 (45kDa)
  ENSP ID: ENSP00000461087
MVLSQRQRDELNRAIADYLRSNGYEEAYSVFKKEAELDVNEELDKKYAGLLEKKWTSVIRLQKKVMELESKLNEAKEEFTSG

SEQ ID NO: 63973 - protein, 392 aa, Homo sapiens
  Payload ID: 12769
  Gene Symbol: PAFAH2
  Gene Name: platelet-activating factor acetylhydrolase 2, 40kDa
  Uniprot ID: Q99487
  ENSP ID: ENSP00000363400
MGVNQSVGFPPVTGPHLVGCGDVMEGQNLQGSFFRLFYPCQKAEETMEQPLWIPRYEYCTGLAEYLQFNKRCGGLLFNLAVGSCRLPVSWNGPFKTKDSGYPLIIFSHGLGAFRTLYSAFCMELASRGFVVAVPEHRDRSAATTYFCKQAPEENQPTNESLQEEWIPFRRVEEGEKEFHVRNPQVHQRVSECLRVLKILQEVTAGQTVFNILPGGLDLMTLKGNIDMSRVAVMGHSFGGATAILALAKETQFRCAVALDAWMFPLERDFYPKARGPVFFINTEKFQTMESVNLMKKICAQHEQSRIITVLGSVHRSQTDFAFVTGNLIGKFFSTETRGSLDPYEGQEVMVRAMLAFLQKHLDLKEDYNQWNNLIEGIGPSLTPGAPHHLSSL

SEQ ID NO: 63974 - protein, 392 aa, Homo sapiens; identical to SEQ ID NO: 63973
  Payload ID: 12769
  Gene Symbol: PAFAH2
  Gene Name: platelet-activating factor acetylhydrolase 2, 40kDa
  Uniprot ID: Q99487
  ENSP ID: ENSP00000363402

SEQ ID NO: 63975 - protein, 185 aa, Homo sapiens
  Payload ID: 12769
  Gene Symbol: PAFAH2
  Gene Name: platelet-activating factor acetylhydrolase 2, 40kDa
  ENSP ID: ENSP00000408313
MGVNQSVGFPPVTGPHLVGCGDVMEGQNLQGSFFRLFYPCQKAEETMEQPLWIPRYEYCTGLAEYLQFNKRCGGLLFNLAVGSCRLPVSWNGPFKTKDSGYPLIIFSHGLGAFRTLYSAFCMELASRGFVVAVPEHRCVYFRDRSAATTYFCKQAPEENQPTNESLQEEWIPFRRVEEGEKEFHV

SEQ ID NO: 63976 - protein, 165 aa, Homo sapiens
  Payload ID: 12769
  Gene Symbol: PAFAH2
  Gene Name: platelet-activating factor acetylhydrolase 2, 40kDa
  ENSP ID: ENSP00000411011
MGVNQSVGFPPVTGPHLVGCGDVMEGQNLQGSFFRLFYPCQKAEETMEQPLWIPRYEYCTGLAEYLQFNKRCGGLLFNLAVGSCRLPVSWNGPFKTKDSGYPLIIFSHGLGAFRTLYSAFCMELASRGFVVAVPEHRDRSAATTYFCKQAPEENQPTNESLQEEW

SEQ ID NO: 63977 - protein, 342 aa, Homo sapiens
  Payload ID: 12770
  Gene Symbol: PTAFR
  Gene Name: platelet-activating factor receptor
  Uniprot ID: P25105
  ENSP ID: ENSP00000301974
MEPHDSSHMDSEFRYTLFPIVYSIIFVLGVIANGYVLWVFARLYPCKKFNEIKIFMVNLTMADMLFLITLPLWIVYYQNQGNWILPKFLCNVAGCLFFINTYCSVAFLGVITYNRFQAVTRPIKTAQANTRKRGISLSLVIWVAIVGAASYFLILDSTNTVPDSAGSGNVTRCFEHYEKGSVPVLIIHIFIVFSFFLVFLIILFCNLVIIRTLLMQPVQQQRNAEVKRRALWMVCTVLAVFIICFVPHHVVQLPWTLAELGFQDSKFHQAINDAHQVTLCLLSTNCVLDPVIYCFLTKKFRKHLTEKFYSMRSSRKCSRATTDTVTEVVVPFNQIPGNSLKN

SEQ ID NO: 63978 - protein, 342 aa, Homo sapiens; identical to SEQ ID NO: 63977
  Payload ID: 12770
  Gene Symbol: PTAFR
  Gene Name: platelet-activating factor receptor
  Uniprot ID: P25105
  ENSP ID: ENSP00000362965

SEQ ID NO: 63979 - protein, 342 aa, Homo sapiens; identical to SEQ ID NO: 63977
  Payload ID: 12770
  Gene Symbol: PTAFR
  Gene Name: platelet-activating factor receptor
  Uniprot ID: P25105
  ENSP ID: ENSP00000442658

SEQ ID NO: 63980 - protein, 211 aa, Homo sapiens [sequence omitted]

SEQ ID NO: 63981 - protein, 205 aa, Homo sapiens
  Payload ID: 12771
  Gene Symbol: PDGFA
  Gene Name: platelet-derived growth factor alpha polypeptide
  ENSP ID: ENSP00000383572
QRQAAALGSQSPSPAGLRAGAVPPARACLQEAEIPREVIERLARSQIHSIRDLQRLLEIDSVGSEDSLDTSLRAHGVHATKHVPEKRPLPIRRKRSIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTDVR

SEQ ID NO: 63982 - protein, 196 aa, Homo sapiens
  Payload ID: 12771
  Gene Symbol: PDGFA
  Gene Name: platelet-derived growth factor alpha polypeptide
  Uniprot ID: P04085
  ENSP ID: ENSP00000383889
MRTLACLLLLGCGYLAHVLAEEAEIPREVIERLARSQIHSIRDLQRLLEIDSVGSEDSLDTSLRAHGVHATKHVPEKRPLPIRRKRSIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTDVR

SEQ ID NO: 63983 - protein, 86 aa, Homo sapiens
  Payload ID: 12771
  Gene Symbol: PDGFA
  Gene Name: platelet-derived growth factor alpha polypeptide
  ENSP ID: ENSP00000384673
MRTLACLLLLGCGYLAHVLAEEAEIPREVIERLARSQIHSIRDLQRLLEIDSVGSEDSLDTSLRAHGVHATKHVPEKRPLPIRRKR

SEQ ID NO: 63984 - protein, 241 aa, Homo sapiens
  Payload ID: 12772
  Gene Symbol: PDGFB
  Gene Name: platelet-derived growth factor beta polypeptide
  Uniprot ID: P01127
  ENSP ID: ENSP00000330382
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 63985 - protein, 226 aa, Homo sapiens
  Payload ID: 12772
  Gene Symbol: PDGFB
  Gene Name: platelet-derived growth factor beta polypeptide
  Uniprot ID: P01127
  ENSP ID: ENSP00000370963
MFIMGLGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 63986 - protein, 144 aa, Homo sapiens
  Payload ID: 12772
  Gene Symbol: PDGFB
  Gene Name: platelet-derived growth factor beta polypeptide
  ENSP ID: ENSP00000402306
MLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDH

SEQ ID NO: 63987 - protein, 136 aa, Homo sapiens
  Payload ID: 12772
  Gene Symbol: PDGFB
  Gene Name: platelet-derived growth factor beta polypeptide
  ENSP ID: ENSP00000405780
MLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKK

SEQ ID NO: 63988 - protein, 1089 aa, Homo sapiens
  Payload ID: 12773
  Gene Symbol: PDGFRA
  Gene Name: platelet-derived growth factor receptor, alpha polypeptide
  Uniprot ID: P16234
  ENSP ID: ENSP00000257290
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 63989 - protein, 743 aa, Homo sapiens
  Payload ID: 12773
  Gene Symbol: PDGFRA
  Gene Name: platelet-derived growth factor receptor, alpha polypeptide
  Uniprot ID: P16234
  ENSP ID: ENSP00000424218
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSSGQGCLSSGTLQELSVDLQARGPC

SEQ ID NO: 63990 - protein, 154 aa, Homo sapiens
  Payload ID: 12773
  Gene Symbol: PDGFRA
  Gene Name: platelet-derived growth factor receptor, alpha polypeptide
  ENSP ID: ENSP00000425232
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTD

SEQ ID NO: 63991 - protein, 147 aa, Homo sapiens
  Payload ID: 12773
  Gene Symbol: PDGFRA
  Gene Name: platelet-derived growth factor receptor, alpha polypeptide
  ENSP ID: ENSP00000425626
MLPRLVLNSWAQMICLPQLPKFPRAMGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVP

SEQ ID NO: 63992 - protein, 218 aa, Homo sapiens
  Payload ID: 12773
  Gene Symbol: PDGFRA
  Gene Name: platelet-derived growth factor receptor, alpha polypeptide
  Uniprot ID: P16234
  ENSP ID: ENSP00000425648
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKGTCIISFLL

SEQ ID NO: 63993 - protein, 159 aa, Homo sapiens
  Payload ID: 12773
  Gene Symbol: PDGFRA
  Gene Name: platelet-derived growth factor receptor, alpha polypeptide
  ENSP ID: ENSP00000425902
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPV

SEQ ID NO: 63994 - protein, 158 aa, Homo sapiens
  Payload ID: 12773
  Gene Symbol: PDGFRA
  Gene Name: platelet-derived growth factor receptor, alpha polypeptide
  ENSP ID: ENSP00000426472
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETP

SEQ ID NO: 63995 - protein, 1106 aa, Homo sapiens
  Payload ID: 12774
  Gene Symbol: PDGFRB
  Gene Name: platelet-derived growth factor receptor, beta polypeptide
  Uniprot ID: P09619
  ENSP ID: ENSP00000261799
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 63996 - protein, 146 aa, Homo sapiens
  Payload ID: 12774
  Gene Symbol: PDGFRB
  Gene Name: platelet-derived growth factor receptor, beta polypeptide
  ENSP ID: ENSP00000429218
MSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQ

SEQ ID NO: 63997 - protein, 239 aa, Homo sapiens
  Payload ID: 12774
  Gene Symbol: PDGFRB
  Gene Name: platelet-derived growth factor receptor, beta polypeptide
  ENSP ID: ENSP00000430026
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQGEPPFWPDAQQSVIHQRLCERSADCGPPG

SEQ ID NO: 63998 - protein, 174 aa, Homo sapiens
  Payload ID: 12774
  Gene Symbol: PDGFRB
  Gene Name: platelet-derived growth factor receptor, beta polypeptide
  ENSP ID: ENSP00000430715
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYD

SEQ ID NO: 63999 - protein, 375 aa, Homo sapiens
  Payload ID: 12775
  Gene Symbol: PDGFRL
  Gene Name: platelet-derived growth factor receptor-like
  Uniprot ID: Q15198
  ENSP ID: ENSP00000251630
MKVWLLLGLLLVHEALEDVTGQHLPKNKRPKEPGENRIKPTNKKVKPKIPKMKDRDSANSAPKTQSIMMQVLDKGRFQKPAATLSLLAGQTVELRCKGSRIGWSYPAYLDTFKDSRLSVKQNERYGQLTLVNSTSADTGEFSCWVQLCSGYICRKDEAKTGSTYIFFTEKGELFVPSPSYFDVVYLNPDRQAVVPCRVTVLSAKVTLHREFPAKEIPANGTDIVYDMKRGFVYLQPHSEHQGVVYCRAEAGGRSQISVKYQLLYVAVPSGPPSTTILASSNKVKSGDDISVLCTVLGEPDVEVEFTWIFPGQKDERPVTIQDTWRLIHRGLGHTTRISQSVITVEDFETIDAGYYICTAQNLQGQTTVATTVEFS

SEQ ID NO: 64000 - protein, 375 aa, Homo sapiens; identical to SEQ ID NO: 63999
  Payload ID: 12775
  Gene Symbol: PDGFRL
  Gene Name: platelet-derived growth factor receptor-like
  Uniprot ID: Q15198
  ENSP ID: ENSP00000444211

SEQ ID NO: 64001 - protein, 350 aa, Homo sapiens
  Payload ID: 12776
  Gene Symbol: PLEK
  Gene Name: pleckstrin
  Uniprot ID: P08567
  ENSP ID: ENSP00000234313
MEPKRIREGYLVKKGSVFNTWKPMWVVLLEDGIEFYKKKSDNSPKGMIPLKGSTLTSPCQDFGKRMFVFKITTTKQQDHFFQAAFLEERDAWVRDIKKAIKCIEGGQKFARKSTRRSIRLPETIDLGALYLSMKDTEKGIKELNLEKDKKIFNHCFTGNCVIDWLVSNQSVRNRQEGLMIASSLLNEGYLQPAGDMSKSAVDGTAENPFLDNPDAFYYFPDSGFFCEENSSDDDVILKEEFRGVIIKQGCLLKQGHRRKNWKVRKFILREDPAYLHYYDPAGAEDPLGAIHLRGCVVTSVESNSNGRKSEEENLFEIITADEVHYFLQAATPKERTEWIRAIQMASRTGK

SEQ ID NO: 64002 - protein, 353 aa, Homo sapiens
  Payload ID: 12777
  Gene Symbol: PLEK2
  Gene Name: pleckstrin 2
  Uniprot ID: Q9NYT0
  ENSP ID: ENSP00000216446
MEDGVLKEGFLVKRGHIVHNWKARWFILRQNTLVYYKLEGGRRVTPPKGRILLDGCTITCPCLEYENRPLLIKLKTQTSTEYFLEACSREERDAWAFEITGAIHAGQPGKVQQLHSLRNSFKLPPHISLHRIVDKMHDSNTGIRSSPNMEQGSTYKKTFLGSSLVDWLISNSFTASRLEAVTLASMLMEENFLRPVGVRSMGAIRSGDLAEQFLDDSTALYTFAESYKKKISPKEEISLSTVELSGTVVKQGYLAKQGHKRKNWKVRRFVLRKDPAFLHYYDPSKEENRPVGGFSLRGSLVSALEDNGVPTGVKGNVQGNLFKVITKDDTHYYIQASSKAERAEWIEAIKKLT

SEQ ID NO: 64003 - protein, 117 aa, Homo sapiens
  Payload ID: 12777
  Gene Symbol: PLEK2
  Gene Name: pleckstrin 2
  ENSP ID: ENSP00000450533
  MOD_RES (1)..(1): Any amino acid
XAEQFLDDSTALYTFAESYKKKISPKEEISLSTVELSGTVVKQGYLAKQEENRPVGGFSLRGSLVSALEDNGVPTGVKGNVQGNLFKVITKDDTHYYIQASSKAERAEWIEAIKKLT

SEQ ID NO: 64004 - protein, 204 aa, Homo sapiens
  Payload ID: 12777
  Gene Symbol: PLEK2
  Gene Name: pleckstrin 2
  ENSP ID: ENSP00000450892
NRPLLIKLKTQTSTEYFLEACSREERDAWAFEITGAIHAGQPGKVQQLHSLRNSFKLPPHISLHRIVDKMHDSNTGIRSSPNMEQGSTYKKTFLGSSLVDWLISNSFTASRLEAVTLASMLMEENFLRPVGVRSMGAIRSGDLAEQFLDDSTALYTFGHKRKNWKVRRFVLRKDPAFLHYYDPSKEENRPVGGFSLRGSLVSAL

SEQ ID NO: 64005 - protein, 77 aa, Homo sapiens
  Payload ID: 12777
  Gene Symbol: PLEK2
  Gene Name: pleckstrin 2
  ENSP ID: ENSP00000451023
MEDGVLKEGFLVKRGHIVHNWKARWFILRQNTLVYYKLEGGRRVTPPKGRILLDGCTITCPCLEYENRPSHCGQDAR

SEQ ID NO: 64006 - protein, 127 aa, Homo sapiens
  Payload ID: 12777
  Gene Symbol: PLEK2
  Gene Name: pleckstrin 2
  ENSP ID: ENSP00000451218
IVHNWKARWFILRQNTLVYYKLEGGRRVTPPKGRILLDGCTITCPCLEYENRPLLIKLKTQTSTEYFLEACSREERDAWAFEITGAIHAGQPGKVQQLHSLRNSFKLPPHISLQDTRGKTGRCVALF

SEQ ID NO: 64007 - protein, 1024 aa, Homo sapiens
  Payload ID: 12778
  Gene Symbol: PSD
  Gene Name: pleckstrin and Sec7 domain containing
  Uniprot ID: A5PKW4
  ENSP ID: ENSP00000020673
MAQGAMRFCSEGDCAISPPRCPRRWLPEGPVPQSPPASMYGSTGSLLRRVAGPGPRGRELGRVTAPCTPLRGPPSPRVAPSPWAPSSPTGQPPPGAQSSVVIFRFVEKASVRPLNGLPAPGGLSRSWDLGGVSPPRPTPALGPGSNRKLRLEASTSDPLPARGGSALPGSRNLVHGPPAPPQVGADGLYSSLPNGLGGPPERLATLFGGPADTGFLNQGDTWSSPREVSSHAQRIARAKWEFFYGSLDPPSSGAKPPEQAPPSPPGVGSRQGSGVAVGRAAKYSETDLDTVPLRCYRETDIDEVLAEREEADSAIESQPSSEGPPGTAYPPAPRPGPLPGPHPSLGSGNEDEDDDEAGGEEDVDDEVFEASEGARPGSRMPLKSPVPFLPGTSPSADGPDSFSCVFEAILESHRAKGTSYTSLASLEALASPGPTQSPFFTFELPPQPPAPRPDPPAPAPLAPLEPDSGTSSAADGPWTQRGEEEEAEARAKLAPGREPPSPCHSEDSLGLGAAPLGSEPPLSQLVSDSDSELDSTERLALGSTDTLSNGQKADLEAAQRLAKRLYRLDGFRKADVARHLGKNNDFSKLVAGEYLKFFVFTGMTLDQALRVFLKELALMGETQERERVLAHFSQRYFQCNPEALSSEDGAHTLTCALMLLNTDLHGHNIGKRMTCGDFIGNLEGLNDGGDFPRELLKALYSSIKNEKLQWAIDEEELRRSLSELADPNPKVIKRISGGSGSGSSPFLDLTPEPGAAVYKHGALVRKVHADPDCRKTPRGKRGWKSFHGILKGMILYLQKEEYKPGKALSETELKNAISIHHALATRASDYSKRPHVFYLRTADWRVFLFQAPSLEQMQSWITRINVVAAMFSAPPFPAAVSSQKKFSRPLLPSAATRLSQEEQVRTHEAKLKAMASELREHRAAQLGKKGRGKEAEEQRQKEAYLEFEKSRYSTYAALLRVKLKAGSEELDAVEAALAQAGSTEDGLPPSHSSPSLQPKPSSQPRAQRHSSEPRPGAGSGRRKP

SEQ ID NO: 64008 - protein, 1024 aa, Homo sapiens; identical to SEQ ID NO: 64007
  Payload ID: 12778
  Gene Symbol: PSD
  Gene Name: pleckstrin and Sec7 domain containing
  Uniprot ID: A5PKW4
  ENSP ID: ENSP00000384830

SEQ ID NO: 64009 - protein, 645 aa, Homo sapiens
  Payload ID: 12778
  Gene Symbol: PSD
  Gene Name: pleckstrin and Sec7 domain containing
  Uniprot ID: A5PKW4
  ENSP ID: ENSP00000481250
MPLKSPVPFLPGTSPSADGPDSFSCVFEAILESHRAKGTSYTSLASLEALASPGPTQSPFFTFELPPQPPAPRPDPPAPAPLAPLEPDSGTSSAADGPWTQRGEEEEAEARAKLAPGREPPSPCHSEDSLGLGAAPLGSEPPLSQLVSDSDSELDSTERLALGSTDTLSNGQKADLEAAQRLAKRLYRLDGFRKADVARHLGKNNDFSKLVAGEYLKFFVFTGMTLDQALRVFLKELALMGETQERERVLAHFSQRYFQCNPEALSSEDGAHTLTCALMLLNTDLHGHNIGKRMTCGDFIGNLEGLNDGGDFPRELLKALYSSIKNEKLQWAIDEEELRRSLSELADPNPKVIKRISGGSGSGSSPFLDLTPEPGAAVYKHGALVRKVHADPDCRKTPRGKRGWKSFHGILKGMILYLQKEEYKPGKALSETELKNAISIHHALATRASDYSKRPHVFYLRTADWRVFLFQAPSLEQMQSWITRINVVAAMFSAPPFPAAVSSQKKFSRPLLPSAATRLSQEEQVRTHEAKLKAMASELREHRAAQLGKKGRGKEAEEQRQKEAYLEFEKSRYSTYAALLRVKLKAGSEELDAVEAALAQAGSTEDGLPPSHSSPSLQPKPSSQPRAQRHSSEPRPGAGSGRRKP

SEQ ID NO: 64010 - protein, 771 aa, Homo sapiens
  Payload ID: 12779
  Gene Symbol: PSD2
  Gene Name: pleckstrin and Sec7 domain containing 2
  Uniprot ID: Q9BQI7
  ENSP ID: ENSP00000274710
MEEDKLLSAVPEEGDATRDPGPEPEEEPGVRNGMASEGLNSSLCSPGHERRGTPADTEEPTKDPDVAFHGLSLGLSLTNGLALGPDLNILEDSAESRPWRAGVLAEGDNASRSLYPDAEDPQLGLDGPGEPDVRDGFSATFEKILESELLRGTQYSSLDSLDGLSLTDESDSCVSFEAPLTPLIQQRARDSPEPGAGLGIGDMAFEGDMGAAGGDGELGSPLRRSISSSRSENVLSRLSLMAMPNGFHEDGPQGPGGDEDDDEEDTDKLLNSASDPSLKDGLSDSDSELSSSEGLEPGSADPLANGCQGVSEAAHRLARRLYHLEGFQRCDVARQLGKNNEFSRLVAGEYLSFFDFSGLTLDGALRTFLKAFPLMGETQERERVLTHFSRRYCQCNPDDSTSEDGIHTLTCALMLLNTDLHGHNIGKKMSCQQFIANLDQLNDGQDFAKDLLKTLYNSIKNEKLEWAIDEDELRKSLSELVDDKFGTGTKKVTRILDGGNPFLDVPQALSATTYKHGVLTRKTHADMDGKRTPRGRRGWKKFYAVLKGTILYLQKDEYRPDKALSEGDLKNAIRVHHALATRASDYSKKSNVLKLKTADWRVFLFQAPSKEEMLSWILRINLVAAIFSAPAFPAAVSSMKKFCRPLLPSCTTRLCQEEQLRSHENKLRQLTAELAEHRCHPVERGIKSKEAEEYRLKEHYLTFEKSRYETYIHLLAMKIKVGSDDLERIEARLATLEGDDPSLRKTHSSPALSQGHVTGSKTTKDATGPDT

SEQ ID NO: 64011 - protein, 513 aa, Homo sapiens
  Payload ID: 12780
  Gene Symbol: PSD3
  Gene Name: pleckstrin and Sec7 domain containing 3
  Uniprot ID: Q9NYI0
  ENSP ID: ENSP00000286485
MGSSWCLYGCCNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHNIGKKMTCQEFIANLQGVNEGVDFSKDLLKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKDEYKPEKALSEEDLKNAVSVHHALASKATDYEKKPNVFKLKTADWRVLLFQTQSPEEMQGWINKINCVAAVFSAPPFPAAIGSQKKFSRPLLPATTTKLSQEEQLKSHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 64012 - protein, 1047 aa, Homo sapiens
  Payload ID: 12780
  Gene Symbol: PSD3
  Gene Name: pleckstrin and Sec7 domain containing 3
  Uniprot ID: Q9NYI0
  ENSP ID: ENSP00000324127
MEGRSAAAETFVWVNNASAHSQSVAKAKYEFLFGRSEGKAPDTSDHGGSTLLPPNVTNEFPEYGTMEEGGEGLRASLEFDGEALPCHPQEQQGVQPLTGCHSGLDSVTEGPKDVREAPSQSHLKEQSLQPIDSLISALKATEARIISGTLQATKVLDQDAVSSFSVQQVEKELDTASRKTQRVNKTLPAGQKNLPEIPLSAEVTTEESFYLSIQKDLTALLTGDTQAEISQIMNNGRKGAVCVQEPSCPLASLGSSAVTCHSAGSVGFLKEQRSALGREHPGGCDRSSSMGRPGRVKHVEFQGVEILWTGGDKRETQHPIDFETSLQRTASPDSKESSKVPRHLISSAGLCNSSSLTENVWDESWKAPSERPGTSSGTFSPVRLDESGEDEVFLQENKQHLEKTPKPERDRERISEQEEHVKGEDEDILGPGYTEDSTDVYSSQFETILDNTSLYYSAESLETLYSEPDSYFSFEMPLTPMIQQRIKEGGQFLERTSGGGHQDILSVSADGGIVMGYSSGVTNGLNDASDSIYTKGTPEIAFWGSNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHNIGKKMTCQEFIANLQGVNEGVDFSKDLLKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKDEYKPEKALSEEDLKNAVSVHHALASKATDYEKKPNVFKLKTADWRVLLFQTQSPEEMQGWINKINCVAAVFSAPPFPAAIGSQKKFSRPLLPATTTKLSQEEQLKSHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 64013 - protein, 376 aa, Homo sapiens
  Payload ID: 12780
  Gene Symbol: PSD3
  Gene Name: pleckstrin and Sec7 domain containing 3
  ENSP ID: ENSP00000393228
MIGVNSVQSASKVRVRTSGSVKYSREDSIRRQSHRSKSMKISNSSEFSAKENKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKDEYKPEKALSEEDLKNAVSVHHALASKATDYEKKPNVFKLKTADWRVLLFQTQSPEEMQGWINKINCVAAVFSAPPFPAAIGSQKKFSRPLLPATTTKLSQEEQLKSHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 64014 - protein, 1048 aa, Homo sapiens
  Payload ID: 12780
  Gene Symbol: PSD3
  Gene Name: pleckstrin and Sec7 domain containing 3
  Uniprot ID: Q9NYI0
  ENSP ID: ENSP00000401704
MEGRSAAAETFVWVNNASAHSQSVAKAKYEFLFGRSEGKAPDTSDHGGSTLLPPNVTNEFPEYGTMEEGGEGLRASLEFDGEALPCHPQEQQGVQPLTGCHSGLDSVTEGPKDVREAPSQSHLKEQSLQPIDSLISALKATEARIISGTLQATKVLDQDAVSSFSVQQVEKELDTASRKTQRVNKTLPAGQKNLPEIPLSAEVTTEESFYLSIQKDLTALLTGDTQAEISQIMNNGRKGAVCVQEPSCPLASLGSSAVTCHSAGSVGFLKEQRSALGREHPGGCDRSSSMGRPGRVKHVEFQGVEILWTGGDKRETQHPIDFETSLQRTASPDSKESSKVPRHLISSAGLCNSSSLTENVWDESWKAPSERPGTSSGTFSPVRLDESGEDEVFLQENKQHLEKTPKPERDRERISEQEEHVKGEDEDILGPGYTEDSTDVYSSQFETILDNTSLYYSAESLETLYSEPDSYFSFEMPLTPMIQQRIKEGGQFLERTSGGGHQDILSVSADGGIVMGYSSGVTNGLNDASDSIYTKGTPEIAFWGSNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHVNIGKKMTCQEFIANLQGVNEGVDFSKDLLKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKDEYKPEKALSEEDLKNAVSVHHALASKATDYEKKPNVFKLKTADWRVLLFQTQSPEEMQGWINKINCVAAVFSAPPFPAAIGSQKKFSRPLLPATTTKLSQEEQLKSHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 64015 - protein, 119 aa, Homo sapiens
  Payload ID: 12780
  Gene Symbol: PSD3
  Gene Name: pleckstrin and Sec7 domain containing 3
  ENSP ID: ENSP00000427897
  MOD_RES (1)..(1): Any amino acid
XLEAHSEMGSTEILEKETPENLSNGTSSNVEAAKRLAKRLYQLDRFKRSDVAKHLGKNNEFSKLVAEEYLKFFDFTGMTLDQSLRVSLCHPGWSAVAPSWLTATSTSQVQAVLLNQPPE

SEQ ID NO: 64016 - protein, 142 aa, Homo sapiens
  Payload ID: 12780
  Gene Symbol: PSD3
  Gene Name: pleckstrin and Sec7 domain containing 3
  ENSP ID: ENSP00000428405
MSDESSSPSMGWKHWPVTSATQDLWGMDPRCRDALGCSPPRAVLVHAADGAERTVLRRGAETCQILPRSCKEATGTTAQATRAWLYRYCPAVHTSKGCPAPPATLPLKAETFVWVNNASAHSQSVAKAKYEFLFGRSEGKAP

SEQ ID NO: 64017 - protein, 167 aa, Homo sapiens
  Payload ID: 12780
  Gene Symbol: PSD3
  Gene Name: pleckstrin and Sec7 domain containing 3
  ENSP ID: ENSP00000428889
MGSSWCLYGCCNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHRWWLLQP

SEQ ID NO: 64018 - protein, 165 aa, Homo sapiens
  Payload ID: 12780
  Gene Symbol: PSD3
  Gene Name: pleckstrin and Sec7 domain containing 3
  ENSP ID: ENSP00000429069
MGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHNIGKKMTCQEFIANLQGVNEGVDFSKDLLK

SEQ ID NO: 64019 - protein, 113 aa, Homo sapiens
  Payload ID: 12780
  Gene Symbol: PSD3
  Gene Name: pleckstrin and Sec7 domain containing 3
  ENSP ID: ENSP00000430043
MGSSWCLYGCCNAGVKTTRLEAHSEMGSTEILEKETPENLSNGTSSNVEAAKRLAKRLYQLDRFKRSDVAKHLGKNNEFSKLVAEEYLKFFDFTGMTLDQSLRKMNLHCQVFL

SEQ ID NO: 64020 - protein, 982 aa, Homo sapiens
  Payload ID: 12780
  Gene Symbol: PSD3
  Gene Name: pleckstrin and Sec7 domain containing 3
  ENSP ID: ENSP00000430640
MEEGGEGLRASLEFDGEALPCHPQEQQGVQPLTGCHSGLDSVTEGPKDVREAPSQSHLKEQSLQPIDSLISALKATEARIISGTLQATKVLDQDAVSSFSVQQVEKELDTASRKTQRVNKTLPAGQKNLPEIPLSAEVTTEESFYLSIQKDLTALLTGDTQAEISQIMNNGRKGAVCVQEPSCPLASLGSSAVTCHSAGSVGFLKEQRSALGREHPGGCDRSSSMGRPGRVKHVEFQGVEILWTGGDKRETQHPIDFETSLQRTASPDSKESSKVPRHLISSAGLCNSSSLTENVWDESWKAPSERPGTSSGTFSPVRLDESGEDEVFLQENKQHLEKTPKPERDRERISEQEEHVKGEDEDILGPGYTEDSTDVYSSQFETILDNTSLYYSAESLETLYSEPDSYFSFEMPLTPMIQQRIKEGGQFLERTSGGGHQDILSVSADGGIVMGYSSGVTNGLNDASDSIYTKGTPEIAFWGSNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHNIGKKMTCQEFIANLQGVNEGVDFSKDLLKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKDEYKPEKALSEEDLKNAVSVHHALASKATDYEKKPNVFKLKTADWRVLLFQTQSPEEMQGWINKINCVAAVFSAPPFPAAIGSQKKFSRPLLPATTTKLSQEEQLKSHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 64021 - protein, 165 aa, Homo sapiens
  Payload ID: 12780
  Gene Symbol: PSD3
  Gene Name: pleckstrin and Sec7 domain containing 3
  ENSP ID: ENSP00000430744
  MOD_RES (1)..(1): Any amino acid
XETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHNIGKKMTCQEFIANLQGVNEGVDFSKDLLKVLWDWRRC

SEQ ID NO: 64022 - protein, 269 aa, Homo sapiens
  Payload ID: 12780
  Gene Symbol: PSD3
  Gene Name: pleckstrin and Sec7 domain containing 3
  ENSP ID: ENSP00000480930
MIGVNSVQSASKVRVRTSGSVKYSREDSIRRQSHRSKSMKISNSSEFSAKENKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 64023 - protein, 269 aa, Homo sapiens
  Payload ID: 12780
  Gene Symbol: PSD3
  Gene Name: pleckstrin and Sec7 domain containing 3
  ENSP ID: ENSP00000484565
MIGVNSVQSASKVRVRTSGSVKYSREDSIRRQSHRSKSMKISNSSEFSAKENKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKDESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 64024 - protein, 1056 aa, Homo sapiens
  Payload ID: 12781
  Gene Symbol: PSD4
  Gene Name: pleckstrin and Sec7 domain containing 4
  Uniprot ID: Q8NDX1
  ENSP ID: ENSP00000245796
MMGDYRLPDHPQPMEILNLYLGDSLEPHPGECPRETCSHEDPPEPFEEQTWATDPPEPTRQNVPPWGSGVELTHLGSWVHQDGLEPCQEQTRATDPPESTRQDAPPWGSGVELTHLGSPSAQREHRQNTASPGSPVNSHLPGSPKQNRSTSTQVVFWAGILQAQMCVLDLEEELEKTEGLKAGLKCCLPTPPVDLPGDTGLHSSPPENEDSGEDSSEPEGEGQAWLREGTPDSSPQWGAEEESMFFSNPLFLASPCSENSASGECFSWGASDSHAGVRTGPESPATLEPPLPEDTVLWELESEPDLGDGAAISGHCTPPFPVPIYKPHSICWASVAAAEGAPAAPPGHGESEGDRLGPAPSAAPCVDEALTWESGCVGSDLGPAAHPVQPWASLSPEGWQRGGPFWPQVTLNSQDRDEREGGHPQESLPCTLAPCPWRSPASSPEPSSPESESRGPGPRPSPASSQEGSPQLQHHSSGILPKWTLDASQSSLLETDGEQPSSLKKKEAGEAPKPGEEVKSEGTARPAETGDVQPDIHLTSAEHENLRTPMNSSWLPGSPMPQAQSPEEGQRPPAGDKLANGVRNNKVAWNLASRLYRLEGFRKSEVAAYLQKNNDFSRAVAEEYLSFFQFGGQSLDRALRSFLQALVLSGETQERERILYQFSRRFHHCNPGIFPSVDSVHTLTCAIMLLNTDLHGQNIGKSMSCQEFITNLNGLRDGGNFPKELLKALYWSIRSEKLEWAVDEEDTARPEKAQPSLPAGKMSKPFLQLAQDPTVPTYKQGILARKMHQDADGKKTPWGKRGWKMFHTLLRGMVLYFLKQGEDHCLEGESLVGQMVDEPVGVHHSLATPATHYTKKPHVFQLRTADWRLYLFQAPTAKEMSSWIARINLAAATHSAPPFPAAVGSQRRFVRPILPVGPAQSSLEEQHRSHENCLDAAADDLLDLQRNLPERRGRGRELEEHRLRKEYLEYEKTRYETYVQLLVARLHCPSDALDLWEEQLGREAGGTREPKLSLKKSHSSPSLHQDEAPTTAKVKRNISERRTYRKIIPKRNRNQL

SEQ ID NO: 64025 - protein, 41 aa, Homo sapiens
  Payload ID: 12781
  Gene Symbol: PSD4
  Gene Name: pleckstrin and Sec7 domain containing 4
  ENSP ID: ENSP00000386373
GPAAHPVQPWASLSPEGWQRGGPFWPQVTLNSQDRAKVLSP

SEQ ID NO: 64026 - protein, 178 aa, Homo sapiens
  Payload ID: 12781
  Gene Symbol: PSD4
  Gene Name: pleckstrin and Sec7 domain containing 4
  ENSP ID: ENSP00000386606
MHQDADGKKTPWGKRGWKMFHTLLRGMVLYFLKGEDHCLEGESLVGQMVDEPVGVHHSLATPATHYTKKPHVFQLRTADWRLYLFQAPRSSIDPTRTAWTLPRTTCWIYRGTCRSGGAVAASWRSTACGRSTWSTRKPATRPTCSCWWPACTAPLMLWTCGRSSWGGKLEALGSPSSA

SEQ ID NO: 64027 - protein, 1027 aa, Homo sapiens
  Payload ID: 12781
  Gene Symbol: PSD4
  Gene Name: pleckstrin and Sec7 domain containing 4
  Uniprot ID: Q8NDX1
  ENSP ID: ENSP00000413997
MMGDYRLPDHPQPMEILNLYLGDSLEPHPGECPRETCSHEDPPEPFEEQTWATDPPEPTRQNVPPWGSGVELTHLGSWVHQDGLEPCQEQTRATDPPESTRQDAPPWGSGVELTHLGSPSAQREHRQNTASPGSPVNSHLPGSPKQNRSTSTQVVFWAGILQAQMCVLDLEEELEKTEGLKAGLKCCLPTPPVDLPGDTGLHSSPPENEDSGEDSSEPEGEGQAWLREGTPDSSPQWGAEEESMFFSNPLFLASPCSENSASGECFSWGASDSHAGVRTGPESPATLEPPLPEDTVLWELESEPDLGDGAAISGHCTPPFPVPIYKPHSICWASVAAAEGAPAAPPGHGESEGDRLGPAPSAAPCVDEALTWESGCVGSDLGPAAHPVQPWASLSPEGWQRGGPFWPQVTLNSQDREPSSPESESRGPGPRPSPASSQEGSPQLQHHSSGILPKWTLDASQSSLLETDGEQPSSLKKKEAGEAPKPGEEVKSEGTARPAETGDVQPDIHLTSAEHENLRTPMNSSWLPGSPMPQAQSPEEGQRPPAGDKLANGVRNNKVAWNLASRLYRLEGFRKSEVAAYLQKNNDFSRAVAEEYLSFFQFGGQSLDRALRSFLQALVLSGETQERERILYQFSRRFHHCNPGIFPSVDSVHTLTCAIMLLNTDLHGQNIGKSMSCQEFITNLNGLRDGGNFPKELLKALYWSIRSEKLEWAVDEEDTARPEKAQPSLPAGKMSKPFLQLAQDPTVPTYKQGILARKMHQDADGKKTPWGKRGWKMFHTLLRGMVLYFLKGEDHCLEGESLVGQMVDEPVGVHHSLATPATHYTKKPHVFQLRTADWRLYLFQAPTAKEMSSWIARINLAAATHSAPPFPAAVGSQRRFVRPILPVGPAQSSLEEQHRSHENCLDAAADDLLDLQRNLPERRGRGRELEEHRLRKEYLEYEKTRYETYVQLLVARLHCPSDALDLWEEQLGREAGGTREPKLSLKKSHSSPSLHQDEAPTTAKVKRNISERRTYRKIIPKRNRNQL

SEQ ID NO: 64028 - protein, 334 aa, Homo sapiens
  Payload ID: 12782
  Gene Symbol: PLEKHA1
  Gene Name: pleckstrin homology domain containing, family A (phosphoinositide binding specific) member 1
  Uniprot ID: Q9HB21
  ENSP ID: ENSP00000357984
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKITVPKQSDSQPNSDNLSRHGECGKKQVSYRTDIVGGVPIITPTQKEEVNECGESIDRNNLKRSQSHLPYFTPKPPQDSAVIKAGYCVKQGAVMKNWKRRYFQLDENTIGYFKSELEKEPLRVIPLKEVHKVQECKQSDIMMRDNLFEIVTTSRTFYVQADSPEEMHSWIKAVSGAIVAQRGPGRSASSMRQARRLSNPCIQRYTSRAGECSTYVGSHANVPS

SEQ ID NO: 64029 - protein, 383 aa, Homo sapiens
  Payload ID: 12782
  Gene Symbol: PLEKHA1
  Gene Name: pleckstrin homology domain containing, family A (phosphoinositide binding specific) member 1
  ENSP ID: ENSP00000357985
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKITVPKQSDSQPNSDNLSRHGECGKKQVSYRTDIVGGVPIITPTQKEEVNECGESIDRNNLKRSQSHLPYFTPKPPQDSAVIKAGYCVKQGAVMKNWKRRYFQLDENTIGYFKSELEKEPLRVIPLKEVHKVQECKQSDIMMRDNLFEIVTTSRTFYVQADSPEEMHSWIKAVSGAIVAQRGPGRSASSMRQARRLSNPCIQRSIPPVLQNPNTLSVLPTQPPPPHIPQPLAATLWSQPLPWRSEDFTSLLPRSSQGTSRSRLSLQENQLPK

SEQ ID NO: 64030 - protein, 404 aa, Homo sapiens
  Payload ID: 12782
  Gene Symbol: PLEKHA1
  Gene Name: pleckstrin homology domain containing, family A (phosphoinositide binding specific) member 1
  Uniprot ID: Q9HB21
  ENSP ID: ENSP00000357986
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKITVPKQSDSQPNSDNLSRHGECGKKQVSYRTDIVGGVPIITPTQKEEVNECGESIDRNNLKRSQSHLPYFTPKPPQDSAVIKAGYCVKQGAVMKNWKRRYFQLDENTIGYFKSELEKEPLRVIPLKEVHKVQECKQSDIMMRDNLFEIVTTSRTFYVQADSPEEMHSWIKAVSGAIVAQRGPGRSASSEHPPGPSESKHAFRPTNAATATSHSTASRSNSLVSTFTMEKRGFYESLAKVKPGNFKVQTVSPREPASKVTEQALLRPQSKNGPQEKDCDLVDLDDASLPVSDV

SEQ ID NO: 64031 - protein, 404 aa, Homo sapiens; identical to SEQ ID NO: 64030
  Payload ID: 12782
  Gene Symbol: PLEKHA1
  Gene Name: pleckstrin homology domain containing, family A (phosphoinositide binding specific) member 1
  Uniprot ID: Q9HB21
  ENSP ID: ENSP00000376547

SEQ ID NO: 64032 - protein, 404 aa, Homo sapiens; identical to SEQ ID NO: 64030
  Payload ID: 12782
  Gene Symbol: PLEKHA1
  Gene Name: pleckstrin homology domain containing, family A (phosphoinositide binding specific) member 1
  Uniprot ID: Q9HB21
  ENSP ID: ENSP00000394416

SEQ ID NO: 64033 - protein, 133 aa, Homo sapiens
  Payload ID: 12782
  Gene Symbol: PLEKHA1
  Gene Name: pleckstrin homology domain containing, family A (phosphoinositide binding specific) member 1
  ENSP ID: ENSP00000473424
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKITVPKQSDSQPNSDNLSRHGE

SEQ ID NO: 64034 - protein, 115 aa, Homo sapiens
  Payload ID: 12783
  Gene Symbol: PLEKHA2
  Gene Name: pleckstrin homology domain containing, family A (phosphoinositide binding specific) member 2
  ENSP ID: ENSP00000429956
MPYVDRQNRICGFLDIEEHENSGKFLRRYFILDTQANCLLWYMDNPQNLAMGAGAVGALQLTYISKVSIATPKQKPKTPFCFVINALSQRYFLQANDQKDMKDWVEALNQASKIT

SEQ ID NO: 64035 - protein, 249 aa, Homo sapiens
  Payload ID: 12783
  Gene Symbol: PLEKHA2
  Gene Name: pleckstrin homology domain containing, family A (phosphoinositide binding specific) member 2
  ENSP ID: ENSP00000430938
MPYVDRQNRICGFLDIEEHENSGKFLRRYFILDTQANCLLWYMDNPQNLAMGAGAVGALQLTYISKVSIATPKQKPKTPFCFVINALSQRYFLQANDQKDMKDWVEALNQASKITVPKGGGLPMTTEVLKSLAAPPALEKKPQVAYKTEIIGGVVVHTPISQNGGDGQEGSEPGSHTILRRSQSYIPTSGCRASTGPPLIKSGYCVKQGNVRKSWKRRFFALDDFTICYFKCEQEFEISLANMVKPRLY

SEQ ID NO: 64036 - protein, 425 aa, Homo sapiens
  Payload ID: 12783
  Gene Symbol: PLEKHA2
  Gene Name: pleckstrin homology domain containing, family A (phosphoinositide binding specific) member 2
  ENSP ID: ENSP00000482228
MPYVDRQNRICGFLDIEEHENSGKFLRRYFILDTQANCLLWYMDNPQNLAMGAGAVGALQLTYISKVSIATPKQKPKTPFCFVINALSQRYFLQANDQKDMKDWVEALNQASKITVPKGGGLPMTTEVLKSLAAPPALEKKPQVAYKTEIIGGVVVHTPISQNGGDGQEGSEPGSHTILRRSQSYIPTSGCRASTGPPLIKSGYCVKQGNVRKSWKRRFFALDDFTICYFKCEQDREPLRTIFLKDVLKTHECLVKSGDLLMRDNLFEIITSSRTFYVQADSPEDMHSWIKEIGAAVQALKCHPRETSFSRSISLTRPGSSSLSSGPNSILCRGRPPLEEKKALCKAPSVASSWQPWTPVPQAGEKLLPPGDTSEDSLFTPRPGEGSAPGVLPSSRIRHRSEPQHPKEKPFMFNLDDENIRTSDV

SEQ ID NO: 64037 - protein, 375 aa, Homo sapiens
  Payload ID: 12783
  Gene Symbol: PLEKHA2
  Gene Name: pleckstrin homology domain containing, family A (phosphoinositide binding specific) member 2
  ENSP ID: ENSP00000482319
MGAGAVGALQLTYISKVSIATPKQKPKTPFCFVINALSQRYFLQANDQKDMKDWVEALNQASKITVPKGGGLPMTTEVLKSLAAPPALEKKPQVAYKTEIIGGVVVHTPISQNGGDGQEGSEPGSHTILRRSQSYIPTSGCRASTGPPLIKSGYCVKQGNVRKSWKRRFFALDDFTICYFKCEQDREPLRTIFLKDVLKTHECLVKSGDLLMRDNLFEIITSSRTFYVQADSPEDMHSWIKEIGAAVQALKCHPRETSFSRSISLTRPGSSSLSSGPNSILCRGRPPLEEKKALCKAPSVASSWQPWTPVPQAGEKLLPPGDTSEDSLFTPRPGEGSAPGVLPSSRIRHRSEPQHPKEKPFMFNLDDENIRTSDV

SEQ ID NO: 64038 - protein, 376 aa, Homo sapiens
  Payload ID: 12783
  Gene Symbol: PLEKHA2
  Gene Name: pleckstrin homology domain containing, family A (phosphoinositide binding specific) member 2
  ENSP ID: ENSP00000483078
MPYVDRQNRICGFLDIEEHENSGKFLRRYFILDTQANCLLWYMDNPQNLAMGAGAVGALQLTYISKVPKGGGLPMTTEVLKSLAAPPALEKKPQVAYKTEIIGGVVVHTPISQNGGDGQEGSEPGSHTILRRSQSYIPTSGCRASTGPPLIKSGYCVKQGNVRKSWKRRFFALDDFTICYFKCEQDREPLRTIFLKDVLKTHECLVKSGDLLMRDNLFEIITSSRTFYVQADSPEDMHSWIKEIGAAVQALKCHPRETSFSRSISLTRPGSSSLSSGPNSILCRGRPPLEEKKALCKAPSVASSWQPWTPVPQAGEKLLPPGDTSEDSLFTPRPGEGSAPGVLPSSRIRHRSEPQHPKEKPFMFNLDDENIRTSDV

SEQ ID NO: 64039 - protein, 300 aa, Homo sapiens
  Payload ID: 12784
  Gene Symbol: PLEKHA3
  Gene Name: pleckstrin homology domain containing, family A (phosphoinositide binding specific) member 3
  Uniprot ID: Q9HB20
  ENSP ID: ENSP00000234453
MEGVLYKWTNYLTGWQPRWFVLDNGILSYYDSQDDVCKGSKGSIKMAVCEIKVHSADNTRMELIIPGEQHFYMKAVNAAERQRWLVALGSSKACLTDTRTKKEKEISETSESLKTKMSELRLYCDLLMQQVHTIQEFVHHDENHSSPSAENMNEASSLLSATCNTFITTLEECVKIANAKFKPEMFQLHHPDPLVSPVSPSPVQMMKRSVSHPGSCSSERSSHSIKEPVSTLHRLSQRRRRTYSDTDSCSDIPLEDPDRPVHCSKNTLNGDLASATIPEESRLMAKKQSESEDTLPSFSS

SEQ ID NO: 64040 - protein, 114 aa, Homo sapiens
  Payload ID: 12784
  Gene Symbol: PLEKHA3
  Gene Name: pleckstrin homology domain containing, family A (phosphoinositide binding specific) member 3
  ENSP ID: ENSP00000396136
DPLVSPVSPSPVQMMKRSVSHPGSCSSERSSHSIKEPVSTLHRLSQRRRRTYSDTDSCSDIPLEDPDNVGGEMKERNREGEGRKKLSWANQARPGREEEERRRVKEVEYVKKVI

SEQ ID NO: 64041 - protein, 61 aa, Homo sapiens
  Payload ID: 12784
  Gene Symbol: PLEKHA3
  Gene Name: pleckstrin homology domain containing, family A (phosphoinositide binding specific) member 3
  ENSP ID: ENSP00000416186
MEGVLYKWTNYLTGWQPRWFVLDNGILSYYDSQDDVCKGSKGSIKMAVCEIKGDNFGGDHP

SEQ ID NO: 64042 - protein, 779 aa, Homo sapiens
  Payload ID: 12785
  Gene Symbol: PLEKHA4
  Gene Name: pleckstrin homology domain containing, family A (phosphoinositide binding specific) member 4
  Uniprot ID: Q9H4M7
  ENSP ID: ENSP00000263265
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQAHSGSPTYLQLPPRPPGTRASMVLLPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKAPVARPRMSAQEQLERMRRNQECGRPFPRPTSPRLLTLGRTLSPARRQPDVEQRPVVGHSGAQKWLRSSGSWSSPRNTTPYLPTSEGHRERVLSLSQALATEASQWHRMMTGGNLDSQGDPLPGVPLPPSDPTRQETPPPRSPPVANSGSTGFSRRGSGRGGGPTPWGPAWDAGIAPPVLPQDEGAWPLRVTLLQSSF

SEQ ID NO: 64043 - protein, 583 aa, Homo sapiens
  Payload ID: 12785
  Gene Symbol: PLEKHA4
  Gene Name: pleckstrin homology domain containing, family A (phosphoinositide binding specific) member 4
  Uniprot ID: Q9H4M7
  ENSP ID: ENSP00000347683
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKSKEHHPLLADFRRSPGAGSQPLPSPGY

SEQ ID NO: 64044 - protein, 26 aa, Homo sapiens
  Payload ID: 12785
  Gene Symbol: PLEKHA4
  Gene Name: pleckstrin homology domain containing, family A (phosphoinositide binding specific) member 4
  ENSP ID: ENSP00000469096
  MOD_RES (1)..(1): Any amino acid
XLRRDPNLPVHIRGWLHKQTAARRVS

SEQ ID NO: 64045 - protein, 59 aa, Homo sapiens
  Payload ID: 12785
  Gene Symbol: PLEKHA4
  Gene Name: pleckstrin homology domain containing, family A (phosphoinositide binding specific) member 4
  ENSP ID: ENSP00000469211
MVEDTLAGLGGPQKPPPHTEPDSPSPVLQGEESSERESLPESLELSSPRSPETDWGRPP

SEQ ID NO: 64046 - protein, 201 aa, Homo sapiens
  Payload ID: 12785
  Gene Symbol: PLEKHA4
  Gene Name: pleckstrin homology domain containing, family A (phosphoinositide binding specific) member 4
  ENSP ID: ENSP00000471274
  MOD_RES (1)..(1): Any amino acid
XLSLASSASTISSLSSLSPKDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSL

SEQ ID NO: 64047 - protein, 119 aa, Homo sapiens
  Payload ID: 12785
  Gene Symbol: PLEKHA4
  Gene Name: pleckstrin homology domain containing, family A (phosphoinositide binding specific) member 4
  ENSP ID: ENSP00000471462
  MOD_RES (1)..(1): Any amino acid
XGGDKDLASPHLGLGSPRVSRASSPEGRHLPSPQLGTKAPVARPRMSAQEQLERMRRNQECGRPFPRPTSPRLLTLGRTLSPARRQPDVEQRSKEHHPLLADFRRSPGAGSQPLPSPGY

SEQ ID NO: 64048 - protein, 126 aa, Homo sapiens
  Payload ID: 12785
  Gene Symbol: PLEKHA4
  Gene Name: pleckstrin homology domain containing, family A (phosphoinositide binding specific) member 4
  ENSP ID: ENSP00000472636
MVLLPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHL

SEQ ID NO: 64049 - protein, 440 aa, Homo sapiens
  Payload ID: 12786
  Gene Symbol: PLEKHA8
  Gene Name: pleckstrin homology domain containing, family A (phosphoinositide binding specific) member 8
  Uniprot ID: Q96JA3
  ENSP ID: ENSP00000258679
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALRNPTENT

SEQ ID NO: 64050 - protein, 455 aa, Homo sapiens
  Payload ID: 12786
  Gene Symbol: PLEKHA8
  Gene Name: pleckstrin homology domain containing, family A (phosphoinositide binding specific) member 8
  Uniprot ID: Q96JA3
  ENSP ID: ENSP00000379556
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALNNAYGKTLRQHHGWVVRGVFAV

SEQ ID NO: 64051 - protein, 439 aa, Homo sapiens
  Payload ID: 12786
  Gene Symbol: PLEKHA8
  Gene Name: pleckstrin homology domain containing, family A (phosphoinositide binding specific) member 8
  ENSP ID: ENSP00000379558
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALSVGMWV

SEQ ID NO: 64052 - protein, 519 aa, Homo sapiens
  Payload ID: 12786
  Gene Symbol: PLEKHA8
  Gene Name: pleckstrin homology domain containing, family A (phosphoinositide binding specific) member 8
  Uniprot ID: Q96JA3
  ENSP ID: ENSP00000397947
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALNNAYGKTLRQHHGWVVRGVFALALRAAPSYEDFVAALTVKEGDHQKEAFSIGMQRDLSLYLPAMEKQLAILDTLYEVHGLESDEVV

SEQ ID NO: 64053 - protein, 545 aa, Homo sapiens
  Payload ID: 12786
  Gene Symbol: PLEKHA8
  Gene Name: pleckstrin homology domain containing, family A (phosphoinositide binding specific) member 8
  ENSP ID: ENSP00000407802
AAGAPRLLGPGAVRGPAGVGRVAAGAMEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALNNAYGKTLRQHHGWVVRGVFALALRAAPSYEDFVAALTVKEGDHQKEAFSIGMQRDLSLYLPAMEKQLAILDTLYEVHGLESDEVV

SEQ ID NO: 64054 - protein, 459 aa, Homo sapiens
  Payload ID: 12786
  Gene Symbol: PLEKHA8
  Gene Name: pleckstrin homology domain containing, family A (phosphoinositide binding specific) member 8
  ENSP ID: ENSP00000484427
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALNNAYGKTLRQHHGWVVRGVFAGHTNV

SEQ ID NO: 64055 - protein, 1116 aa, Homo sapiens
  Payload ID: 12787
  Gene Symbol: PLEKHA5
  Gene Name: pleckstrin homology domain containing, family A member 5
  Uniprot ID: Q9HAU0
  ENSP ID: ENSP00000299275
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 64056 - protein, 1098 aa, Homo sapiens
  Payload ID: 12787
  Gene Symbol: PLEKHA5
  Gene Name: pleckstrin homology domain containing, family A member 5
  Uniprot ID: Q9HAU0
  ENSP ID: ENSP00000400411
MTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTMKENEPIITMVHTMIENSALRPQLYQQLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEEEEVVPPRPPLPRSYDFTEQPPIIPPLPSDSSSLLCYSRGPVHLPEEKKMYQVQGYPRNGSHCGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 64057 - protein, 1282 aa, Homo sapiens
  Payload ID: 12787
  Gene Symbol: PLEKHA5
  Gene Name: pleckstrin homology domain containing, family A member 5
  Uniprot ID: Q9HAU0
  ENSP ID: ENSP00000404296
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRITFNFRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTPEELTLLLIKLRRQQAELSSIREHTLAQLMQLKLEAHSPKNEILSHHLQRNTIYLDHQMKENEPIITMVHTMIENSALRPQLYQQFLRQKSKISLYCLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEEEEVVPPRPPLPRSYDFTEQPPIIPPLPSDSSSLLCYSRGPVHLPEEKKMYQVQGYPRNGSHCGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 64058 - protein, 76 aa, Homo sapiens
  Payload ID: 12787
  Gene Symbol: PLEKHA5
  Gene Name: pleckstrin homology domain containing, family A member 5
  Uniprot ID: Q9HAU0
  ENSP ID: ENSP00000439396
MAADLNLEWISLPRSWTYGITRGGRVFFINEEAKSTTWLHPVTGEAVVTGHRRQSTDLPTGWEEAYTFEGARYYIN

SEQ ID NO: 64059 - protein, 1174 aa, Homo sapiens
  Payload ID: 12787
  Gene Symbol: PLEKHA5
  Gene Name: pleckstrin homology domain containing, family A member 5
  Uniprot ID: Q9HAU0
  ENSP ID: ENSP00000439673
MAADLNLEWISLPRSWTYGITRGGRVFFINEEAKSTTWLHPVTGEAVVTGHRRQSTDLPTGWEEAYTFEGARYYINHNERKVTCKHPVTGQPSQDNCIFVVNEQTVATMTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTPEELTLLLIKLRRQQAELSSIREHTLAQLMQLKLEAHSPKNEILSHHLQRNTIYLDHQLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 64060 - protein, 977 aa, Homo sapiens
  Payload ID: 12787
  Gene Symbol: PLEKHA5
  Gene Name: pleckstrin homology domain containing, family A member 5
  ENSP ID: ENSP00000440371
MTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTSEDHINRKYAFKAAHPNMRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEEEEVVPPRPPLPRSYDFTEQPPIIPPLPSDSSSLLCYSRGPVHLPEEKKMYQVQGYPRNGSHCGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMD

SEQ ID NO: 64061 - protein, 874 aa, Homo sapiens
  Payload ID: 12787
  Gene Symbol: PLEKHA5
  Gene Name: pleckstrin homology domain containing, family A member 5
  ENSP ID: ENSP00000440611
MRTYYFCTDTGKEMELWMKAMLDAALVQTEPVKRVDKITSENAPTKETNNIPNHRVLIKPEIQNNQKNKEMSKIEEKKALEAEKYGFQKDGQDRPLTKINSVKLNSLPSEYESGSACPAQTVHYRPINLSSSENKIVNVSLADLRGGNRPNTGPLYTEADRVIQRTNSMQQLEQWIKIQKGRGHEEETRGVISYQTLPRNMPSHRAQIMARYPEGYRTLPRNSKTRPESICSVTPSTHDKTLGPGAEEKRRSMRDDTMWQLYEWQQRQFYNKQSTLPRHSTLSSPKTMVNISDQTMHSIPTSPSHGSIAAYQGYSPQRTYRSEVSSPIQRGDVTIDRRHRAHHPKHVYVPDRRSVPAGLTLQSVSPQSLQGKTLSQDEGRGTLYKYRPEEVDIDAKLSRLCEQDKVVHALEEKLQQLHKEKYTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 64062 - protein, 135 aa, Homo sapiens
  Payload ID: 12787
  Gene Symbol: PLEKHA5
  Gene Name: pleckstrin homology domain containing, family A member 5
  ENSP ID: ENSP00000441777
  MOD_RES (1)..(1): Any amino acid
XAYQGYSPQRTYRSEVSSPIQRGDVTIDRRHRAHHPKHVYVPDRRSVPAGLTLQSVSPQSLQGKTPEELTLLLIKLRRQQAELSSIREHTLAQLMQLKLEAHSPKNEILSHHLQRNTIYLDHQLCCKLMFAVCSS

SEQ ID NO: 64063 - protein, 397 aa, Homo sapiens
  Payload ID: 12787
  Gene Symbol: PLEKHA5
  Gene Name: pleckstrin homology domain containing, family A member 5
  ENSP ID: ENSP00000443553
YTLEQALLSASQEIEMHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 64064 - protein, 118 aa, Homo sapiens
  Payload ID: 12787
  Gene Symbol: PLEKHA5
  Gene Name: pleckstrin homology domain containing, family A member 5
  ENSP ID: ENSP00000446308
MTSEEKKERPISMINEASNYNVTSDYAVHPMSPVGRTSRASKKVHNFGKRSNSIKRNPNAPVVRRGWLYKQDSTGMKLWKKRWFVLSDLCLFYYRDEKEEGILGSILLPSFQIALLTS

SEQ ID NO: 64065 - protein, 1048 aa, Homo sapiens
  Payload ID: 12788
  Gene Symbol: PLEKHA6
  Gene Name: pleckstrin homology domain containing, family A member 6
  Uniprot ID: Q9Y2H5
  ENSP ID: ENSP00000272203
MSNKTGGKRPATTNSDIPNHNMVSEVPPERPSVRATRTARKAVAFGKRSHSMKRNPNAPVTKAGWLFKQASSGVKQWNKRWFVLVDRCLFYYKDEKEESILGSIPLLSFRVAAVQPSDNISRKHTFKAEHAGVRTYFFSAESPEEQEAWIQAMGEAARVQIPPAQKSVPQAVRHSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTALTNSTIEYEHLESEVSALHDDLWEQLNLDTQNEVLNRQIQKEIWRIQDVMEGLRKNNPSRGTDTAKHRGGLGPSATYSSNSPASPLSSASLTSPLSPFSLVSGSQGSPTKPGSNEPKANYEQSKKDPHQTLPLDTPRDISLVPTRQEVEAEKQAALNKVGVVPPRTKSPTDDEVTPSAVVRRNASGLTNGLSSQERPKSAVFPGEGKVKMSVEEQIDRMRRHQSGSMREKRRSLQLPASPAPDPSPRPAYKVVRRHRSIHEVDISNLEAALRAEEPGGHAYETPREEIARLRKMELEPQHYDVDINKELSTPDKVLIPERYIDLEPDTPLSPEELKEKQKKVERIKTLIAKSSMQNVVPIGEGDSVDVPQDSESQLQEQEKRIEISCALATEASRRGRMLSVQCATPSPPTSPASPAPPANPLSSESPRGADSSYTMRV

SEQ ID NO: 64066 - protein, 1068 aa, Homo sapiens
  Payload ID: 12788
  Gene Symbol: PLEKHA6
  Gene Name: pleckstrin homology domain containing, family A member 6
  ENSP ID: ENSP00000402046
MSNKTGGKRPATTNSDIPNHNMVSEVPPERPSVRATRTARKAVAFGKRSHSMKRNPNAPVTKAGWLFKQASSGVKQWNKRWFVLVDRCLFYYKDEKEESILGSIPLLSFRVAAVQPSDNISRKHTFKVTVCWVDEAEASSTRCLSPQAEHAGVRTYFFSAESPEEQEAWIQAMGEAARVQIPPAQKSVPQAVRHSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTALTNSTIEYEHLESEVSALHDDLWEQLNLDTQNEVLNRQIQKEIWRIQDVMEGLRKNNPSRGTDTAKHRGGLGPSATYSSNSPASPLSSASLTSPLSPFSLVSGSQGSPTKPGSNEPKANYEQSKKDPHQTLPLDTPRDISLVPTRQEVEAEKQAALNKVGVVPPRTKSPTDDEVTPSAVVRRNASGLTNGLSSQERPKSAVFPGEGKVKMSVEEQIDRMRRHQSGSMREKRRSLQLPASPAPDPSPRPAYKVVRRHRSIHEVDISNLEAALRAEEPGGHAYETPREEIARLRKMELEPQHYDVDINKELSTPDKVLIPERYIDLEPDTPLSPEELKEKQKKVERIKTLIAKSSMQNVVPIGEGDSVDVPQDSESQLQEQEKRIEISCALATEASRRGRMLSVQCATPSPPTSPASPAPPANPLSSESPRGADSSYTMRV

SEQ ID NO: 64067 - protein, 1121 aa, Homo sapiens
  Payload ID: 12789
  Gene Symbol: PLEKHA7
  Gene Name: pleckstrin homology domain containing, family A member 7
  Uniprot ID: Q6IQ23
  ENSP ID: ENSP00000347883
MAAATVGRDTLPEHWSYGVCRDGRVFFINDQLRCTTWLHPRTGEPVNSGHMIRSDLPRGWEEGFTEEGASYFIDHNQQTTAFRHPVTGQFSPENSEFILQEEPNPHMSKQDRNQRPSSMVSETSTAGTASTLEAKPGPKIIKSSSKVHSFGKRDQAIRRNPNVPVVVRGWLHKQDSSGMRLWKRRWFVLADYCLFYYKDSREEAVLGSIPLPSYVISPVAPEDRISRKYSFKAVHTGMRALIYNSSTAGSQAEQSGMRTYYFSADTQEDMNAWVRAMNQAAQVLSRSSLKRDMEKVERQAVPQANHTESCHECGRVGPGHTRDCPHRGHDDIVNFERQEQEGEQYRSQRDPLEGKRDRSKARSPYSPAEEDALFMDLPTGPRGQQAQPQRAEKNGMLPASYGPGEQNGTGGYQRAFPPRTNPEKHSQRKSNLAQVEHWARAQKGDSRSLPLDQTLPRQGPGQSLSFPENYQTLPKSTRHPSGGSSPPPRNLPSDYKYAQDRASHLKMSSEERRAHRDGTVWQLYEWQQRQQFRHGSPTAPICLGSPEFTDQGRSRSMLEVPRSISVPPSPSDIPPPGPPRVFPPRRPHTPAERVTVKPPDQRRSVDISLGDSPRRARGHAVKNSSHVDRRSMPSMGYMTHTVSAPSLHGKSADDTYLQLKKDLEYLDLKMTGRDLLKDRSLKPVKIAESDTDVKLSIFCEQDRVLQDLEDKIRALKENKDQLESVLEVLHRQMEQYRDQPQHLEKIAYQQKLLQEDLVHIRAELSRESTEMENAWNEYLKLENDVEQLKQTLQEQHRRAFFFQEKSQIQKDLWRIEDVTAGLSANKENFRILVESVKNPERKTVPLFPHPPVPSLSTSESKPPPQPSPPTSPVRTPLEVRLFPQLQTYVPYRPHPPQLRKVTSPLQSPTKAKPKVEDEAPPRPPLPELYSPEDQPPAVPPLPREATIIRHTSVRGLKRQSDERKRDRELGQCVNGDSRVELRSYVSEPELATLSGDMAQPSLGLVGPESRYQTLPGRGLSGSTSRLQQSSTIAPYVTLRRGLNAESSKATFPRPKSALERLYSGDHQRGKMSAEEQLERMKRHQKALVRERKRTLGQGERTGLPSSRYLSRPLPGDLGSVC

SEQ ID NO: 64068 - protein, 152 aa, Homo sapiens
  Payload ID: 12789
  Gene Symbol: PLEKHA7
  Gene Name: pleckstrin homology domain containing, family A member 7
  ENSP ID: ENSP00000431455
MTGRDLLKDRSLKPVKIAESDTDVKLSIFCEQDRVLQDLEDKIRALKENKDQLESVLEVLHRQMEQYRDQPQHLEKIAYQQKLLQEDLVHIRAELSRESTEMENAWNEYLKLENDVEQLKQTLQEQHRRAFFFQEKSQIQKDLWRIEDVTAG

SEQ ID NO: 64069 - protein, 753 aa, Homo sapiens
  Payload ID: 12789
  Gene Symbol: PLEKHA7
  Gene Name: pleckstrin homology domain containing, family A member 7
  ENSP ID: ENSP00000433467
  MOD_RES (1)..(1): Any amino acid
XDALFMDLPTGPRGQQAQPQRAEKNGMLPASYGPGEQNGTGGYQRAFPPRTNPEKHSQRKSNLAQVEHWARAQKGDSRSLPLDQTLPRQGPGQSLSFPENYQTLPKSTRHPSGGSSPPPRNLPSDYKYAQDRASHLKMSSEERRAHRDGTVWQLYEWQQRQQFRHGSPTAPICLGSPEFTDQGRSRSMLEVPRSISVPPSPSDIPPPGPPRVFPPRRPHTPAERVTVKPPDQRRSVDISLGDSPRRARGHAVKNSSHVDRRSMPSMGYMTHTVSAPSLHGKSADDTYLQLKKDLEYLDLKMTGRDLLKDRSLKPVKIAESDTDVKLSIFCEQDRVLQDLEDKIRALKENKDQLESVLEVLHRQMEQYRDQPQHLEKIAYQQKLLQEDLVHIRAELSRESTEMENAWNEYLKLENDVEQLKQTLQEQHRRAFFFQEKSQIQKDLWRIEDVTAGLSANKENFRILVESVKNPERKTVPLFPHPPVPSLSTSESKPPPQPSPPTSPVRTPLEVRLFPQLQTYVPYRPHPPQLRKVTSPLQSPTKAKPKVQEDEAPPRPPLPELYSPEDQPPAVPPLPREATIIRHTSVRGLKRQSDERKRDRELGQCVNGDSRVELRSYVSEPELATLSGDMAQPSLGLVGPESRYQTLPGRGLSGSTSRLQQSSTIAPYVTLRRGLNAESSKATFPRPKSALERLYSGDHQRGKMSAEEQLERMKRHQKALVRERKRTLGQGERTGLPSSRYLSRPLPGDLGSVC

SEQ ID NO: 64070 - protein, 77 aa, Homo sapiens
  Payload ID: 12789
  Gene Symbol: PLEKHA7
  Gene Name: pleckstrin homology domain containing, family A member 7
  ENSP ID: ENSP00000434812
MAASSSSMTSSAARPGCIRAPGSPSTRGPRQGSSSRPPLLPTSHSGGVSMPKAARRPSLDLRVPWSACTQGITSEAR

SEQ ID NO: 64071 - protein, 1271 aa, Homo sapiens
  Payload ID: 12789
  Gene Symbol: PLEKHA7
  Gene Name: pleckstrin homology domain containing, family A member 7
  ENSP ID: ENSP00000435389
MAAATVGRDTLPEHWSYGVCRDGRVFFINDQLRCTTWLHPRTGEPVNSGHMIRSDLPRGWEEGFTEEGASYFIDHNQQTTAFRHPVTGQFSPENSEFILQEEPNPHMSKQDRNQRPSSMVSETSTAGTASTLEAKPGPKIIKSSSKVHSFGKRDQAIRRNPNVPVVVRGWLHKQDSSGMRLWKRRWFVLADYCLFYYKDSREEAVLGSIPLPSYVISPVAPEDRISRKYSFKAVHTGMRALIYNSSTAGSQAEQSGMRTYYFSADTQEDMNAWVRAMNQAAQVLSRSSLKRDMEKVERQAVPQANHTESCHECGRVGPGHTRDCPHRGHDDIVNFERQEQEGEQYRSQRDPLEGKRDRSKARSPYSPAEEDALFMDLPTGPRGQQAQPQRAEKNGMLPASYGPGEQNGTGGYQRAFPPRTNPEKHSQRKSNLAQVEHWARAQKGDSRSLPLDQTLPRQGPGQSLSFPENYQTLPKSTRHPSGGSSPPPRNLPSDYKYAQDRASHLKMSSEERRAHRDGTVWQLYEWQQRQQFRHGSPTAPICLGSPEFTDQGRSRSMLEVPRSISVPPSPSDIPPPGPPRVFPPRRPHTPAERVTVKPPDQRRSVDISLGDSPRRARGHAVKNSSHVDRRSMPSMGYMTHTVSAPSLHGKSADDTYLQLKKDLEYLDLKMTGRDLLKDRSLKPVKIAESDTDVKLSIFCEQDRVLQDLEDKIRALKENKDQLESVLEVLHRQMEQYRDQPQHLEKIAYQQKLLQEDLVHIRAELSRESTEMENAWNEYLKLENDVEQLKQTLQEQHRRAFFFQEKSQIQKDLWRIEDVTAGLSANKENFRILVESVKNPERKTVPLFPHPPVPSLSTSESKPPPQPSPPTSPVRTPLEVRLFPQLQTYVPYRPHPPQLRKVTSPLQSPTKAKPKVEDEAPPRPPLPELYSPEDQPPAVPPLPREATIIRHTSVRGLKRQSDERKRDRELGQCVNGDSRVELRSYVSEPELATLSGDMAQPSLGLVGPESRYQTLPGRGLSGSTSRLQQSSTIAPYVTLRRGLNAESSKATFPRPKSALERLYSGDHQRGKMSAEEQLERMKRHQKALVRERKRTLGQGERTGLPSSRYLSRPLPGDLGSWKREQDFDLQLLERVVQGEKKDKEENGWLKVQAMPVTELDLEPQDYDLDISRELSKPEKVSIPERYVELDPEEPPSLEELQARYRKAEKIRNILARSSMCNLQPTSGQDQNSVADLDLQLQEQERIINISYALASEASQRSKQVAAQAVTDP

SEQ ID NO: 64072 - protein, 123 aa, Homo sapiens
  Payload ID: 12789
  Gene Symbol: PLEKHA7
  Gene Name: pleckstrin homology domain containing, family A member 7
  ENSP ID: ENSP00000435806
MSKQDRNQRPSSMVSETSTAGTASTLEAKPGPKIIKSSSKVHSFGKRDQAIRRNPNVPVVVRGWLHKQDSSGMRLWKRRWFVLADYCLFYYKDSREEAVLGSIPLPSYVISPVAPEDRISRKY

SEQ ID NO: 64073 - protein, 189 aa, Homo sapiens
  Payload ID: 12790
  Gene Symbol: PLEKHB1
  Gene Name: pleckstrin homology domain containing, family B (evectins) member 1
  Uniprot ID: Q9UF11
  ENSP ID: ENSP00000227214
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 64074 - protein, 243 aa, Homo sapiens
  Payload ID: 12790
  Gene Symbol: PLEKHB1
  Gene Name: pleckstrin homology domain containing, family B (evectins) member 1
  Uniprot ID: Q9UF11
  ENSP ID: ENSP00000346127
MSPAAPVPPDSALESPFEEMALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPAPAGATVPPRSRRVCSKVRCVTRSWSPCKVERRIWVRVYSPYQDYYEVVPPNAHEATYVRSYYGPPYAGPGVTHVIVREDPCYSAGAPLAMGMLAGAATGAALGSLMWSPCWF

SEQ ID NO: 64075 - protein, 208 aa, Homo sapiens
  Payload ID: 12790
  Gene Symbol: PLEKHB1
  Gene Name: pleckstrin homology domain containing, family B (evectins) member 1
  Uniprot ID: Q9UF11
  ENSP ID: ENSP00000381505
MSPAAPVPPDSALESPFEEMALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 64076 - protein, 224 aa, Homo sapiens
  Payload ID: 12790
  Gene Symbol: PLEKHB1
  Gene Name: pleckstrin homology domain containing, family B (evectins) member 1
  Uniprot ID: Q9UF11
  ENSP ID: ENSP00000381507
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPAPAGATVPPRSRRVCSKVRCVTRSWSPCKVERRIWVRVYSPYQDYYEVVPPNAHEATYVRSYYGPPYAGPGVTHVIVREDPCYSAGAPLAMGMLAGAATGAALGSLMWSPCWF

SEQ ID NO: 64077 - protein, 117 aa, Homo sapiens
  Payload ID: 12790
  Gene Symbol: PLEKHB1
  Gene Name: pleckstrin homology domain containing, family B (evectins) member 1
  ENSP ID: ENSP00000438809
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSP

SEQ ID NO: 64078 - protein, 146 aa, Homo sapiens
  Payload ID: 12790
  Gene Symbol: PLEKHB1
  Gene Name: pleckstrin homology domain containing, family B (evectins) member 1
  ENSP ID: ENSP00000439714
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPMIRLKLIHPHNKYLLSCYYGPGGVPSARDQRCAST

SEQ ID NO: 64079 - protein, 160 aa, Homo sapiens
  Payload ID: 12790
  Gene Symbol: PLEKHB1
  Gene Name: pleckstrin homology domain containing, family B (evectins) member 1
  ENSP ID: ENSP00000440102
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPAPAGATVPPRSRRVCSKVRCVTRSWSPCKVERRIWVRVYSPYQDYYEVV

SEQ ID NO: 64080 - protein, 68 aa, Homo sapiens
  Payload ID: 12790
  Gene Symbol: PLEKHB1
  Gene Name: pleckstrin homology domain containing, family B (evectins) member 1
  ENSP ID: ENSP00000440122
MALVRGGWLWRQSSILRRWKRNWFALWLDGTLGYYHDETAQDEEDRVLIHFNVRDIKIGPECHGEPGT

SEQ ID NO: 64081 - protein, 138 aa, Homo sapiens
  Payload ID: 12790
  Gene Symbol: PLEKHB1
  Gene Name: pleckstrin homology domain containing, family B (evectins) member 1
  ENSP ID: ENSP00000441224
MALVRGGWLWRQNVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 64082 - protein, 180 aa, Homo sapiens
  Payload ID: 12790
  Gene Symbol: PLEKHB1
  Gene Name: pleckstrin homology domain containing, family B (evectins) member 1
  ENSP ID: ENSP00000441558
MALVRGGWLWRQMHLEYRTGSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGA

SEQ ID NO: 64083 - protein, 163 aa, Homo sapiens
  Payload ID: 12790
  Gene Symbol: PLEKHB1
  Gene Name: pleckstrin homology domain containing, family B (evectins) member 1
  ENSP ID: ENSP00000442136
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGA

SEQ ID NO: 64084 - protein, 189 aa, Homo sapiens; identical to SEQ ID NO: 64073
  Payload ID: 12790
  Gene Symbol: PLEKHB1
  Gene Name: pleckstrin homology domain containing, family B (evectins) member 1
  Uniprot ID: Q9UF11
  ENSP ID: ENSP00000442616

SEQ ID NO: 64085 - protein, 84 aa, Homo sapiens
  Payload ID: 12790
  Gene Symbol: PLEKHB1
  Gene Name: pleckstrin homology domain containing, family B (evectins) member 1
  ENSP ID: ENSP00000443899
MALVRGGWLWRQSSILRRWKRNWFALWLDGTLGYYHDETAQDEEDRVLIHFNVRDIKIGPECHDVQPPEGRSRDGLLTVNLREG

SEQ ID NO: 64086 - protein, 154 aa, Homo sapiens
  Payload ID: 12790
  Gene Symbol: PLEKHB1
  Gene Name: pleckstrin homology domain containing, family B (evectins) member 1
  ENSP ID: ENSP00000444453
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVR

SEQ ID NO: 64087 - protein, 151 aa, Homo sapiens
  Payload ID: 12790
  Gene Symbol: PLEKHB1
  Gene Name: pleckstrin homology domain containing, family B (evectins) member 1
  ENSP ID: ENSP00000445807
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGKSPACP

SEQ ID NO: 64088 - protein, 154 aa, Homo sapiens
  Payload ID: 12790
  Gene Symbol: PLEKHB1
  Gene Name: pleckstrin homology domain containing, family B (evectins) member 1
  ENSP ID: ENSP00000445990
MALVRGGWLWRQMHLEYRTGSILRRWKRNWFALWLDGTLGYYHDETAQDEEDRVLIHFNVRDIKIGPECHDVQPPEGRSRDGLLTVNLREGGRLHLCAETKDDALAWKTALLEANSTPAPAGATVPPRSRRVCSKVRCVTRSWSPCKVERRIWV

SEQ ID NO: 64089 - protein, 221 aa, Homo sapiens
  Payload ID: 12791
  Gene Symbol: PLEKHB2
  Gene Name: pleckstrin homology domain containing, family B (evectins) member 2
  Uniprot ID: Q96CS7
  ENSP ID: ENSP00000234115
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEAYGYGPYGGAYPPGTQVVYAANGQAYAVPYQYPYAGLYGQQPANQVIIRERYRDNDSDLALGMLAGAATGMALGSLFWVF

SEQ ID NO: 64090 - protein, 309 aa, Homo sapiens
  Payload ID: 12791
  Gene Symbol: PLEKHB2
  Gene Name: pleckstrin homology domain containing, family B (evectins) member 2
  ENSP ID: ENSP00000385609
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEELHSKGPKIHTTTSAKTQAVLPTRCFFPSESPIRRSVQISVLLPAVNIRRRIKLTFPQPARPRAPRSLCLWQTWFAGKRAPSLPTAATAPALPSCPSPPAPSQALPPSLAGWRSPSSAPLPPEQALAPRSFQLSKHQARPRPHRPGTPPVPAWPGVPPPPPARPPALR

SEQ ID NO: 64091 - protein, 236 aa, Homo sapiens
  Payload ID: 12791
  Gene Symbol: PLEKHB2
  Gene Name: pleckstrin homology domain containing, family B (evectins) member 2
  ENSP ID: ENSP00000385892
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEQAYGYGPYGGAYPPGTQVVYAANGQAYAVPYQYPYAETILMTRHCTAVSRGLYGQQPANQVIIRERYRDNDSDLALGMLAGAATGMALGSLFWVF

SEQ ID NO: 64092 - protein, 230 aa, Homo sapiens
  Payload ID: 12791
  Gene Symbol: PLEKHB2
  Gene Name: pleckstrin homology domain containing, family B (evectins) member 2
  Uniprot ID: Q96CS7
  ENSP ID: ENSP00000386410
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEVGRTLSLQQAYGYGPYGGAYPPGTQVVYAANGQAYAVPYQYPYAGLYGQQPANQVIIRERYRDNDSDLALGMLAGAATGMALGSLFWVF

SEQ ID NO: 64093 - protein, 222 aa, Homo sapiens
  Payload ID: 12791
  Gene Symbol: PLEKHB2
  Gene Name: pleckstrin homology domain containing, family B (evectins) member 2
  Uniprot ID: Q96CS7
  ENSP ID: ENSP00000386662
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEQAYGYGPYGGAYPPGTQVVYAANGQAYAVPYQYPYAGLYGQQPANQVIIRERYRDNDSDLALGMLAGAATGMALGSLFWVF

SEQ ID NO: 64094 - protein, 222 aa, Homo sapiens; identical to SEQ ID NO: 64093
  Payload ID: 12791
  Gene Symbol: PLEKHB2
  Gene Name: pleckstrin homology domain containing, family B (evectins) member 2
  Uniprot ID: Q96CS7
  ENSP ID: ENSP00000386666

SEQ ID NO: 64095 - protein, 171 aa, Homo sapiens
  Payload ID: 12791
  Gene Symbol: PLEKHB2
  Gene Name: pleckstrin homology domain containing, family B (evectins) member 2
  ENSP ID: ENSP00000389629
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCFRLMAMGHTVVRTRQELKLSTLRMGRRMPCPTSTHMQDFMDSSLLTKSSFESAIETTTATWHWACWQEQPRAWP

SEQ ID NO: 64096 - protein, 178 aa, Homo sapiens
  Payload ID: 12791
  Gene Symbol: PLEKHB2
  Gene Name: pleckstrin homology domain containing, family B (evectins) member 2
  Uniprot ID: Q96CS7
  ENSP ID: ENSP00000401193
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEDFMDSSLLTKSSFESAIETTTATWHWACWQEQPRAWP

SEQ ID NO: 64097 - protein, 170 aa, Homo sapiens
  Payload ID: 12791
  Gene Symbol: PLEKHB2
  Gene Name: pleckstrin homology domain containing, family B (evectins) member 2
  Uniprot ID: Q96CS7
  ENSP ID: ENSP00000487321
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLLMAMGHTVVRTRQELKLSTLRMGRRMPCPTSTHMQDFMDSSLLTKSSFESAIETTTATWHWACWQEQPRAWP

SEQ ID NO: 64098 - protein, 506 aa, Homo sapiens
  Payload ID: 12792
  Gene Symbol: PLEKHD1
  Gene Name: pleckstrin homology domain containing, family D (with coiled-coil domains) member 1
  Uniprot ID: A6NEE1
  ENSP ID: ENSP00000317175
MFTSKSNSVSPSPSLEQADSDALDISTKVQLYGVLWKRPFGRPSAKWSRRFFIIKESFLLYYSESEKKSFETNKYFNIHPKGVIPLGGCLVEPKEEPSMPYAMKISHQDFHGNILLAAESEFEQTQWLEMLQESGKVTWKNAQLGEAMIKSLEAQGLQLAKEKQEYLDKLMEETEELCLQREQREELERLNQVLEAEKQQFEEVVQELRMEQEQIKRELELTARCLKGVEQEKKELRHLTESLQQTLEELSIEKKKTLEMLEENENHLQTLANQSEQPPPSGGLHSNLRQIEEKMQQLLEEKLLAEKRMKENEERSRALEEEREFYSSQSQALQNSLQELTAEKQQAERELKAEVKVRMDLERRLREAEGALRSLEQGLNSKVRNKEKEERMRADVSHLKRFFEECIRNAELEAKMPVIMKNSVYIHKAATRRIKSCRFHRRRSSTSWNDMKPSQSFMTSQLDANNMEELKEVAKRLSRDQRFRESIYHIMATQPGAPSALSRGGK

SEQ ID NO: 64099 - protein, 279 aa, Homo sapiens
  Payload ID: 12793
  Gene Symbol: PLEKHF1
  Gene Name: pleckstrin homology domain containing, family F (with FYVE domain) member 1
  Uniprot ID: Q96S99
  ENSP ID: ENSP00000389787
MVDHLANTEINSQRIAAVESCFGASGQPLALPGRVLLGEGVLTKECRKKAKPRIFFLFNDILVYGSIVLNKRKYRSQHIIPLEEVTLELLPETLQAKNRWMIKTAKKSFVVSAASATERQEWISHIEECVRRQLRATGRPPSTEHAAPWIPDKATDICMRCTQTRFSALTRRHHCRKCGFVVCAECSRQRFLLPRLSPKPVRVCSLCYRELAAQQRQEEAEEQGAGSPGQPAHLARPICGASSGDDDDSDEDKEGSRDGDWPSSVEFYASGVAWSAFHS

SEQ ID NO: 64100 - protein, 82 aa, Homo sapiens
  Payload ID: 12793
  Gene Symbol: PLEKHF1
  Gene Name: pleckstrin homology domain containing, family F (with FYVE domain) member 1
  ENSP ID: ENSP00000464925
MVDHLANTEINSQRIAAVESCFGASGQPLALPGRVLLGEGVLTKECRKKAKPRIFFLFNDILVYGSIVLNKRKYRSQHIIPL

SEQ ID NO: 64101 - protein, 128 aa, Homo sapiens
  Payload ID: 12793
  Gene Symbol: PLEKHF1
  Gene Name: pleckstrin homology domain containing, family F (with FYVE domain) member 1
  ENSP ID: ENSP00000466003
MVDHLANTEINSQRIAAVESCFGASGQPLALPGRVLLGEGVLTKECRKKAKPRIFFLFNDILVYGSIVLNKRKYRSQHIIPLEEVTLELLPETLQAKNRWMIKTAKKSFVVSAASATERQEWISHIEE

SEQ ID NO: 64102 - protein, 279 aa, Homo sapiens; identical to SEQ ID NO: 64099
  Payload ID: 12793
  Gene Symbol: PLEKHF1
  Gene Name: pleckstrin homology domain containing, family F (with FYVE domain) member 1
  Uniprot ID: Q96S99
  ENSP ID: ENSP00000466292

SEQ ID NO: 64103 - protein, 249 aa, Homo sapiens
  Payload ID: 12794
  Gene Symbol: PLEKHF2
  Gene Name: pleckstrin homology domain containing, family F (with FYVE domain) member 2
  Uniprot ID: Q9H8W4
  ENSP ID: ENSP00000322373
MVDRLANSEANTRRISIVENCFGAAGQPLTIPGRVLIGEGVLTKLCRKKPKARQFFLFNDILVYGNIVIQKKKYNKQHIIPLENVTIDSIKDEGDLRNGWLIKTPTKSFAVYAATATEKSEWMNHINKCVTDLLSKSGKTPSNEHAAVWVPDSEATVCMRCQKAKFTPVNRRHHCRKCGFVVCGPCSEKRFLLPSQSSKPVRICDFCYDLLSAGDMATCQPARSDSYSQSLKSPLNDMSDDDDDDDSSD

SEQ ID NO: 64104 - protein, 249 aa, Homo sapiens; identical to SEQ ID NO: 64103
  Payload ID: 12794
  Gene Symbol: PLEKHF2
  Gene Name: pleckstrin homology domain containing, family F (with FYVE domain) member 2
  Uniprot ID: Q9H8W4
  ENSP ID: ENSP00000427792

SEQ ID NO: 64105 - protein, 1385 aa, Homo sapiens
  Payload ID: 12795
  Gene Symbol: PLEKHG1
  Gene Name: pleckstrin homology domain containing, family G (with RhoGef domain) member 1
  Uniprot ID: Q9ULL1
  ENSP ID: ENSP00000351318
MELSDSDRPVSFGSTSSSASSRDSHGSFGSRMTLVSNSHMGLFNQDKEVGAIKLELIPARPFSSSELQRDNPATGQQNADEGSERPPRAQWRVDSNGAPKTIADSATSPKLLYVDRVVQEILETERTYVQDLKSIVEDYLDCIRDQTKLPLGTEERSALFGNIQDIYHFNSELLQDLENCENDPVAIAECFVSKSEEFHIYTQYCTNYPRSVAVLTECMRNKILAKFFRERQETLKHSLPLGSYLLKPVQRILKYHLLLHEIENHLDKDTEGYDVVLDAIDTMQRVAWHINDMKRKHEHAVRLQEIQSLLTNWKGPDLTSYGELVLEGTFRIQRAKNERTLFLFDKLLLITKKRDDTFTYKAHILCGNLMLVEVIPKEPLSFSVFHYKNPKLQHTVQAKSQQDKRLWVLHLKRLILENHAAKIPAKAKQAILEMDAIHHPGFCYSPEGGTKALFGSKEGSAPYRLRRKSEPSSRSHKVLKTSETAQDIQKVSREEGSPQLSSARPSPAQRNSQPSSSTMISVLRAGGALRNIWTDHQIRQALFPSRRSPQENEDDEDDYQMFVPSFSSSDLNSTRLCEDSTSSRPCSWHMGQMESTETSSSGHRIVRRASSAGESNTCPPEIGTSDRTRELQNSPKTEGQEEMTPFGSSIELTIDDIDHVYDNISYEDLKLMVAKREEAESTPSKSARDSVRPKSTPELAFTKRQAGHSKGSLYAQTDGTLSGGEASSQSTHELQAVEENIYDTIGLPDPPSLGFKCSSLKRAKRSTFLGLEADFVCCDSLRPFVSQDSLQLSEDEAPYHQATPDHGYLSLLYDSPSGNLSMPHKPVSDKLSEEVDEIWNDLENYIKKNEDKARDRLLAAFPVSKDDVPDRLHAESTPELSRDVGRSVSTLSLPESQALLTPVKSRAGRASRANCPFEEDLISKEGSFMSLNRLSLASEMPLMDNPYDLANSGLSQTDPENPDLGMEATDKTKSRVFMMARQYSQKIKKANQLLKVKSLELEQPPASQHQKSMHKDLAAILEEKKQGGPAIGARIAEYSQLYDQIVFRESPLKIQKDGWASPQESSLLRSVSPSQVHHGSGDWLLHSTYSNGELADFCLPPEQDLRSRYPTFEINTKSTPRQLSAACSVPSLQTSDPLPGSVQRCSVVVSQPNKENWCQDHLYNSLGRKGISAKSQPYHRSQSSSSVLINKSMDSINYPSDVGKQQLLSLHRSSRCESHQDLLPDIADSHQQGTEKLSDLTLQDSQKVVVVNRNLPLNAQIATQNYFSNFKETDGDEDDYVEIKSEEDESELELSHNRRRKSDSKFVDADFSDNVCSGNTLHSLNSPRTPKKPVNSKLGLSPYLTPYNDSDKLNDYLWRGPSPNQQNIVQSLREKFQCLSSSSFA

SEQ ID NO: 64106 - protein, 46 aa, Homo sapiens
  Payload ID: 12795
  Gene Symbol: PLEKHG1
  Gene Name: pleckstrin homology domain containing, family G (with RhoGef domain) member 1
  ENSP ID: ENSP00000356295
MELSDSDRPVSFGSTSSSASSRDSHGSFGSRMTLVSNSHMGLFNQD

SEQ ID NO: 64107 - protein, 1385 aa, Homo sapiens; identical to SEQ ID NO: 64105
  Payload ID: 12795
  Gene Symbol: PLEKHG1
  Gene Name: pleckstrin homology domain containing, family G (with RhoGef domain) member 1
  Uniprot ID: Q9ULL1
  ENSP ID: ENSP00000356297

SEQ ID NO: 64108 - protein, 392 aa, Homo sapiens
  Payload ID: 12795
  Gene Symbol: PLEKHG1
  Gene Name: pleckstrin homology domain containing, family G (with RhoGef domain) member 1
  ENSP ID: ENSP00000433107
EERSALFGNIQDIYHFNSELLQDLENCENDPVAIAECFVSKSEEFHIYTQYCTNYPRSVAVLTECMRNKILAKFFRERQETLKHSLPLGSYLLKPVQRILKYHLLLHEIENHLDKDTEGYDVVLDAIDTMQRVAWHINDMKRKHEHAVRLQEIQSLLTNWKGPDLTSYGELVLEGTFRIQRAKNERTLFLFDKLLLITKKRDDTFTYKAHILCGNLMLVEVIPKEPLSFSVFHYKNPKLQHTVQAKSQQDKRLWVLHLKRLILENHAAKIPAKAKQAILEMDAIHHPGFCYSPEGGTKALFGSKEGSAPYRLRRKSEPSSRSHKVLKTSETAQDIQKVSREEGSPQLSSARPSPAQRNSQPSSSTMISVLRAGGALRNIWTDHQISTTFGNG

SEQ ID NO: 64109 - protein, 1254 aa, Homo sapiens
  Payload ID: 12796
  Gene Symbol: PLEKHG2
  Gene Name: pleckstrin homology domain containing, family G (with RhoGef domain) member 2
  ENSP ID: ENSP00000205135
  MOD_RES (1)..(1): Any amino acid
XRVAREIVETERAYVRDLRSIVEDYLGPLLDGGVLGLSVEQVGTLFANIEDIYEFSSELLEDLENSSSAGGIAECFVQRSEDFDIYTLYCMNYPSSLALLRELSLSPPAALWLQERQAQLRHSLPLQSFLLKPVQRILKYHLLLQELGKHWAEGPGTGGREMVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAKPGFKHAGSEGELYPPESQPPVSGSAPPEDLEDAGPPTLDPSGTSITEEILELLNQRGLRDPGPSTHDIPKFPGDSQVPGDSETLTFQALPSRDSSEEEEEEEEGLEMDERGPSPLHVLEGLESSIAAEMPSIPCLTKIPDVPNLPEIPSRCEIPEGSRLPSLSDISDVFEMPCLPAIPSVPNTPSLSSTPTLSCDSWLQGPLQEPAEAPATRRELFSGSNPGKLGEPPSGGKAGPEEDEEGVSFTDFQPQDVTQHQGFPDELAFRSCSEIRSAWQALEQGQLARPGFPEPLLILEDSDLGGDSGSGKAGAPSSERTASRVRELARLYSERIQQMQRAETRASANAPRRRPRVLAQPQPSPCLPQEQAEPGLLPAFGHVLVCELAFPLTCAQESVPLGPAVWVQAAIPLSKQGGSPDGQGLHVSNLPKQDLPGIHVSAATLLPEQGGSRHVQAPAATPLPKQEGPLHLQVPALTTFSDQGHPEIQVPATTPLPEHRSHMVIPAPSTAFCPEQGHCADIHVPTTPALPKEICSDFTVSVTTPVPKQEGHLDSESPTNIPLTKQGGSRDVQGPDPVCSQPIQPLSWHGSSLDPQGPGDTLPPLPCHLPDLQIPGTSPLPAHGSHLDHRIPANAPLSLSQELPDTQVPATTPLPLPQVLTDIWVQALPTSPKQGSLPDIQGPAAAPPLPEPSLTDTQVQKLTPSLEQKSLIDAHVPAATPLPERGGSLDIQGLSPTPVQTTMVLSKPGGSLASHVARLESSDLTPPHSPPPSSRQLLGPNAAALSRYLAASYISQSLARRQGPGGGAPAASRGSWSSAPTSRASSPPPQPQPPPPPARRLSYATTVNIHVGGGGRLRPAKAQVRLNHPALLASTQESMGLHRAQGAPDAPFHM

SEQ ID NO: 64110 - protein, 577 aa, Homo sapiens
  Payload ID: 12796
  Gene Symbol: PLEKHG2
  Gene Name: pleckstrin homology domain containing, family G (with RhoGef domain) member 2
  Uniprot ID: Q9H7P9
  ENSP ID: ENSP00000386492
MPEGAQGLSLSKPSPSLGCGRRGEVCDCGTVCETRTAPAAPTMASPRGSGSSTSLSTVGSEGDPAPGPTPACSASRPEPLPGPPIRLHLSPVGIPGSARPSRLERVAREIVETERAYVRDLRSIVEDYLGPLLDGGVLGLSVEQVGTLFANIEDIYEFSSELLEDLENSSSAGGIAECFVQRSEDFDIYTLYCMNYPSSLALLRELSLSPPAALWLQERQAQLRHSLPLQSFLLKPVQRILKYHLLLQELGKHWAEGPGTGGREMVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGESMGLHRAQGAPDAPFHM

SEQ ID NO: 64111 - protein, 1386 aa, Homo sapiens
  Payload ID: 12796
  Gene Symbol: PLEKHG2
  Gene Name: pleckstrin homology domain containing, family G (with RhoGef domain) member 2
  Uniprot ID: Q9H7P9
  ENSP ID: ENSP00000392906
MPEGAQGLSLSKPSPSLGCGRRGEVCDCGTVCETRTAPAAPTMASPRGSGSSTSLSTVGSEGDPAPGPTPACSASRPEPLPGPPIRLHLSPVGIPGSARPSRLERVAREIVETERAYVRDLRSIVEDYLGPLLDGGVLGLSVEQVGTLFANIEDIYEFSSELLEDLENSSSAGGIAECFVQRSEDFDIYTLYCMNYPSSLALLRELSLSPPAALWLQERQAQLRHSLPLQSFLLKPVQRILKYHLLLQELGKHWAEGPGTGGREMVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGPSTHDIPKFPGDSQVPGDSETLTFQALPSRDSSEEEEEEEEGLEMDERGPSPLHVLEGLESSIAAEMPSIPCLTKIPDVPNLPEIPSRCEIPEGSRLPSLSDISDVFEMPCLPAIPSVPNTPSLSSTPTLSCDSWLQGPLQEPAEAPATRRELFSGSNPGKLGEPPSGGKAGPEEDEEGVSFTDFQPQDVTQHQGFPDELAFRSCSEIRSAWQALEQGQLARPGFPEPLLILEDSDLGGDSGSGKAGAPSSERTASRVRELARLYSERIQQMQRAETRASANAPRRRPRVLAQPQPSPCLPQEQAEPGLLPAFGHVLVCELAFPLTCAQESVPLGPAVWVQAAIPLSKQGGSPDGQGLHVSNLPKQDLPGIHVSAATLLPEQGGSRHVQAPAATPLPKQEGPLHLQVPALTTFSDQGHPEIQVPATTPLPEHRSHMVIPAPSTAFCPEQGHCADIHVPTTPALPKEICSDFTVSVTTPVPKQEGHLDSESPTNIPLTKQGGSRDVQGPDPVCSQPIQPLSWHGSSLDPQGPGDTLPPLPCHLPDLQIPGTSPLPAHGSHLDHRIPANAPLSLSQELPDTQVPATTPLPLPQVLTDIWVQALPTSPKQGSLPDIQGPAAAPPLPEPSLTDTQVQKLTPSLEQKSLIDAHVPAATPLPERGGSLDIQGLSPTPVQTTMVLSKPGGSLASHVARLESSDLTPPHSPPPSSRQLLGPNAAALSRYLAASYISQSLARRQGPGGGAPAASRGSWSSAPTSRASSPPPQPQPPPPPARRLSYATTVNIHVGGGGRLRPAKAQVRLNHPALLASTQESMGLHRAQGAPDAPFHM

SEQ ID NO: 64112 - protein, 127 aa, Homo sapiens
  Payload ID: 12796
  Gene Symbol: PLEKHG2
  Gene Name: pleckstrin homology domain containing, family G (with RhoGef domain) member 2
  ENSP ID: ENSP00000397615
MPEGAQGLSLSKPSPSLGCGRRGEVCDCGTVCETRTAAPAAPTMASPRGSGSSTSLSTVGSEGDPAPGPTPACSASRPEPLPGPPIRLHLSPVGIPGSARPSRLERVAREIVETERAYVRDLRSIVE

SEQ ID NO: 64113 - protein, 1237 aa, Homo sapiens
  Payload ID: 12796
  Gene Symbol: PLEKHG2
  Gene Name: pleckstrin homology domain containing, family G (with RhoGef domain) member 2
  ENSP ID: ENSP00000408857
MPEGAQGLSLSKPSPSLGCGRRGEVCDCGTVCETRTGSARPSRLERVAREIVETERAYVRDLRSIVEDYLGPLLDGGVLGLSVEQVGTLFANIEDIYEFSSELLEDLENSSSAGGIAECFVQRSEDFDIYTLYCMNYPSSLALLRELSLSPPAALWLQERQAQLRHSLPLQSFLLKPVQRILKYHLLLQELGKHWAEGPGTGGREMVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGPSTHDIPKFPGDSQVPGDSETLTFQALPSRDSSEEEEEEEEGLEMDERGPSPLHVLEGLESSIAAEMPSIPCLTKIPDVPNLPEIPSRCEIPEGSRLPSLSDISDVFEMPCLPAIPSVPNTPSLSSTPTLSCDSWLQGPLQEPAEAPATRRELFSGSNPGKLGEPPSGGKAGPEEDEEGVSFTDFQPQDVTQHQGFPDELAFRSCSEIRSAWQALEQGQLARPGFPEPLLILEDSDLGGDSGSGKAGAPSSERTASRVRELARLYSERIQQMQRAETRASANAPRRRPRVLAQPQPSPCLPQEQAEPGLLPAFGHVLVCELAFPLTCAQESVPLGPAVWVQAAIPLSKQGGSPDGQGLHVSNLPKQDLPGIHVSAATLLPEQGGSRHVQAPAATPLPKQEGPLHLQVPALTTFSDQGHPEIQVPATTPLPEHRSHMVIPAPSTAFCPEQGHCADIHVPTTPALPKEICSDFTVSVTTPVPKQEGHLDSESPTNIPLTKQGGSRDVQGPDPVCSQPIQPLSWHGSSLDPQGPGDTLPPLPCHLPDLQIPGTSPLPAHGSHLDHRIPANAPLSLSQELPDTQVPATTPLPLPQVLTDIWVQALPTSPKQGSLPDIQGPAAAPPLPEPSLTDTQVQKLTPSLEQKSLIDAHVPAATPLPERGGSLDIQGLSPTPVQTTMVLSKPGGSLASHVARNLWAFTGPRGLLMPPSTCEPGHEASLKQGFQPDAIDPQNLTWKSRH

SEQ ID NO: 64114 - protein, 198 aa, Homo sapiens
  Payload ID: 12796
  Gene Symbol: PLEKHG2
  Gene Name: pleckstrin homology domain containing, family G (with RhoGef domain) member 2
  ENSP ID: ENSP00000412818
MPEGAQGLSLSKPSPSLGCGRRGEVCDCGTVCETRTAAPAAPTMASPRGSGSSTSLSTVGSEGDPAPGPTPACSASRPEPLPGPPIRLHLSPVGIPGSARPSRLERVAREIVETERAYVRDLRSIVEDYLGPLLDGGVLGLSVEQVGTLFANIEDIYEFSSELLEDLENSSSAGGIAECFVQRSEDFDIYTLYCMNYP

SEQ ID NO: 64115 - protein, 115 aa, Homo sapiens
  Payload ID: 12796
  Gene Symbol: PLEKHG2
  Gene Name: pleckstrin homology domain containing, family G (with RhoGef domain) member 2
  ENSP ID: ENSP00000468829
SPRPRDARSFTPGRRNTAPSPGPSVIRRGRRQSAKPGFKHAGSEGELYPPESQPPVSGSAPPEDLEDAGPPTLDPSGTSITEEILELLNQRGLRDPGESMGLHRAQGAPDAPFHM

SEQ ID NO: 64116 - protein, 153 aa, Homo sapiens
  Payload ID: 12796
  Gene Symbol: PLEKHG2
  Gene Name: pleckstrin homology domain containing, family G (with RhoGef domain) member 2
  ENSP ID: ENSP00000470763
TPLPLPQVLTDIWVQALPTSPKQGSLPDIQGPAAAPPLPEPSLTDTQVQKLTPSLEQKSLIDAHVPAATPLPERGGSLDIQGLSPTPVQTTMVLSKPGGSLASHVARNLWAFTGPRGLLMPPSTCEPGHEASLKQGFQPDAIDPQNLTWKSRH

SEQ ID NO: 64117 - protein, 41 aa, Homo sapiens
  Payload ID: 12796
  Gene Symbol: PLEKHG2
  Gene Name: pleckstrin homology domain containing, family G (with RhoGef domain) member 2
  ENSP ID: ENSP00000471460
  MOD_RES (1)..(1): Any amino acid
XIPRAQATPYHPCHVTSQTFRFQESMGLHRAQGAPDAPFHM

SEQ ID NO: 64118 - protein, 84 aa, Homo sapiens
  Payload ID: 12796
  Gene Symbol: PLEKHG2
  Gene Name: pleckstrin homology domain containing, family G (with RhoGef domain) member 2
  ENSP ID: ENSP00000472989
  MOD_RES (1)..(1): Any amino acid
XLPERGGSLDIQGLSPTPVQTTMVLSKPGGSLASHVARNLWAFTGPRGLLMPPSTCEPGHEASLKQGFQPDAIDPQNLTWKSRH

SEQ ID NO: 64119 - protein, 48 aa, Homo sapiens
  Payload ID: 12796
  Gene Symbol: PLEKHG2
  Gene Name: pleckstrin homology domain containing, family G (with RhoGef domain) member 2
  ENSP ID: ENSP00000473068
MPEGAQGLSLSKPSPSLGCGRRGEVCDCGTVCETRTGEPRGRGGGACG

SEQ ID NO: 64120 - protein, 95 aa, Homo sapiens
  Payload ID: 12796
  Gene Symbol: PLEKHG2
  Gene Name: pleckstrin homology domain containing, family G (with RhoGef domain) member 2
  ENSP ID: ENSP00000473213
  MOD_RES (1)..(1): Any amino acid
XFQGCSGPRPCLQSTHPAFVLAWKQPGSPGPRRHPTTLAMSPPRPSDSRNLWAFTGPRGLLMPPSTCEPGHEASLKQGFQPDAIDPQNLTWKSRH

SEQ ID NO: 64121 - protein, 103 aa, Homo sapiens
  Payload ID: 12796
  Gene Symbol: PLEKHG2
  Gene Name: pleckstrin homology domain containing, family G (with RhoGef domain) member 2
  ENSP ID: ENSP00000473251
EDSDLGGDSGSGKAGAPSSERTASRVRELARLYSERIQQMQRAETRASANAPRRRPRVLAQPQPSPCLPQEQAEPGLLPAFGHVLESMGLHRAQGAPDAPFHM

SEQ ID NO: 64122 - protein, 1219 aa, Homo sapiens
  Payload ID: 12797
  Gene Symbol: PLEKHG3
  Gene Name: pleckstrin homology domain containing, family G (with RhoGef domain) member 3
  Uniprot ID: A1L390
  ENSP ID: ENSP00000247226
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVEDYLLKIIDTPGLLKPEQVSALFGNIENIYALNSQLLRDLDSCNSDPVAVASCFVERSQEFDIYTQYCNNYPNSVAALTECMRDKQQAKFFRDRQELLQHSLPLGSYLLKPVQRILKYHLLLQEIAKHFDEEEDGFEVVEDAIDTMTCVAWYINDMKRRHEHAVRLQEIQSLLINWKGPDLTTYGELVLEGTFRVHRVRNERTFFLFDKTLLITKKRGDHFVYKGNIPCSSLMLIESTRDSLCFTVTHYKHSKQQYSIQAKTVEEKRNWTHHIKRLILENHHATIPQKAKEAILEMDSYYPNRYRCSPERLKKAWSSQDEVSTNVRQGRRQSEPTKHLLRQLNEKARAAGMKGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 64123 - protein, 1163 aa, Homo sapiens
  Payload ID: 12797
  Gene Symbol: PLEKHG3
  Gene Name: pleckstrin homology domain containing, family G (with RhoGef domain) member 3
  Uniprot ID: A1L390
  ENSP ID: ENSP00000378183
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVESQEFDIYTQYCNNYPNSVAALTECMRDKQQAKFFRDRQELLQHSLPLGSYLLKPVQRILKYHLLLQEIAKHFDEEEDGFEVVEDAIDTMTCVAWYINDMKRRHEHAVRLQEIQSLLINWKGPDLTTYGELVLEGTFRVHRVRNERTFFLFDKTLLITKKRGDHFVYKGNIPCSSLMLIESTRDSLCFTVTHYKHSKQQYSIQAKTVEEKRNWTHHIKRLILENHHATIPQKAKEAILEMDSYYPNRYRCSPERLKKAWSSQDEVSTNVRQGRRQSEPTKHLLRQLNEKARAAGMKGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 64124 - protein, 188 aa, Homo sapiens
  Payload ID: 12797
  Gene Symbol: PLEKHG3
  Gene Name: pleckstrin homology domain containing, family G (with RhoGef domain) member 3
  ENSP ID: ENSP00000450501
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVEDYLLKIIDTPGLLKPEQVSALFGNIENIYALNSQLLRDLDSCNSDPVAVASCFVERSQEFDIYTQYCNNYP

SEQ ID NO: 64125 - protein, 62 aa, Homo sapiens
  Payload ID: 12797
  Gene Symbol: PLEKHG3
  Gene Name: pleckstrin homology domain containing, family G (with RhoGef domain) member 3
  ENSP ID: ENSP00000450880
MGALLRKANLPGVPSPGSNARMPVSTSLHQDGSQERPVSLTSTTSSSGSSCDSRSAMEEPSS

SEQ ID NO: 64126 - protein, 752 aa, Homo sapiens
  Payload ID: 12797
  Gene Symbol: PLEKHG3
  Gene Name: pleckstrin homology domain containing, family G (with RhoGef domain) member 3
  Uniprot ID: A1L390
  ENSP ID: ENSP00000450945
MGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 64127 - protein, 724 aa, Homo sapiens
  Payload ID: 12797
  Gene Symbol: PLEKHG3
  Gene Name: pleckstrin homology domain containing, family G (with RhoGef domain) member 3
  ENSP ID: ENSP00000450973
MSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 64128 - protein, 161 aa, Homo sapiens
  Payload ID: 12797
  Gene Symbol: PLEKHG3
  Gene Name: pleckstrin homology domain containing, family G (with RhoGef domain) member 3
  ENSP ID: ENSP00000451256
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVEDYLLKIIDTPGLLKPEQVSALFGNIENIYALNSQLLRDLDSCNS

SEQ ID NO: 64129 - protein, 603 aa, Homo sapiens
  Payload ID: 12797
  Gene Symbol: PLEKHG3
  Gene Name: pleckstrin homology domain containing, family G (with RhoGef domain) member 3
  ENSP ID: ENSP00000489373
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVESQEFDIYTQYCNNYPNSVAALTECMRDKQQAKFFRDRQELLQHSLPLGSYLLKPVQRILKYHLLLQEIAKHFDEEEDGFEVVEDAIDTMTCVAWYINDMKRRHEHAVRLQEIQSLLINWKGPDLTTYGELVLEGTFRVHRVRNERTFFLFDKTLLITKKRGDHFVYKGNIPCSSLMLIESTRDSLCFTVTHYKHSKQQYSIQAKTVEEKRNWTHHIKRLILENHHATIPQKAKEAILEMDSYYPNRYRCSPERLKKAWSSQDEVSTNVRQGRRQSEPTKHLLRQLNEKARAAGMKGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATD

SEQ ID NO: 64130 - protein, 1191 aa, Homo sapiens
  Payload ID: 12798
  Gene Symbol: PLEKHG4
  Gene Name: pleckstrin homology domain containing, family G (with RhoGef domain) member 4
  Uniprot ID: Q58EX7
  ENSP ID: ENSP00000353646
MERPLENGDESPDSQGHATDWRFAVCSFRDAWEEEEPASQMHVKDPGPPRPPAGATQDEELQGSPLSRKFQLPPAADESGDAQRGTVESSSVLSEGPGPSGVESLLCPMSSHLSLAQGESDTPGVGLVGDPGPSRAMPSGLSPGALDSDPVGLGDPLSEISKLLEAAPSGSGLPKPADCLLAQDLCWELLASGMATLPGTRDVQGRAVLLLCAHSPAWLQSECSSQELIRLLLYLRSIPRPEVQALGLTVLVDARICAPSSSLFSGLSQLQEAAPGAVYQVLLVGSTLLKEVPSGLQLEQLPSQSLLTHIPTAGLPTSLGGGLPYCHQAWLDFRRRLEALLQNCQAACALLQGAIESVKAVPQPMEPGEVGQLLQQTEVLMQQVLDSPWLAWLQCQGGRELTWLKQEVPEVTLSPDYRTAMDKADELYDRVDGLLHQLTLQSNQRIQALELVQTLEARESGLHQIEVWLQQVGWPALEEAGEPSLDMLLQAQGSFQELYQVAQEQVRQGEKFLQPLTGWEAAELDPPGARFLALRAQLTEFSRALAQRCQRLADAERLFQLFREALTWAEEGQRVLAELEQERPGVVLQQLQLHWTRHPDLPPAHFRKMWALATGLGSEAIRQECRWAWARCQDTWLALDQKLEASLKLPPVGSTASLCVSQVPAAPAHPPLRKAYSFDRNLGQSLSEPACHCHHAATIAACRRPEAGGGALPQASPTVPPPGSSDPRSLNRLQLVLAEMVATEREYVRALEYTMENYFPELDRPDVPQGLRGQRAHLFGNLEKLRDFHCHFFLRELEACTRHPPRVAYAFLRHRVQFGMYALYSKNKPRSDALMSSYGHTFFKDKQQALGDHLDLASYLLKPIQRMGKYALLLQELARACGGPTQELSALREAQSLVHFQLRHGNDLLAMDAIQGCDVNLKEQGQLVRQDEFVVRTGRHKSVRRIFLFEELLLFSKPRHGPTGVDTFAYKRSFKMADLGLTECCGNSNLRFEIWFRRRKARDTFVLQASSLAIKQAWTADISHLLWRQAVHNKEVRMAEMVSMGVGNKAFRDIAPSEEAINDRTVNYVLKCREVRSRASIAVAPFDHDSLYLGASNSLPGDPASCSVLGSLNLHLYRDPALLGLRCPLYPSFPEEAALEAEAELGGQPSLTAEDSEISSQCPSASGSSGSDSSCVSGQALGRGLEDLPCV

SEQ ID NO: 64131 - protein, 1191 aa, Homo sapiens; identical to SEQ ID NO: 64130
  Payload ID: 12798
  Gene Symbol: PLEKHG4
  Gene Name: pleckstrin homology domain containing, family G (with RhoGef domain) member 4
  Uniprot ID: Q58EX7
  ENSP ID: ENSP00000368649

SEQ ID NO: 64132 - protein, 1110 aa, Homo sapiens
  Payload ID: 12798
  Gene Symbol: PLEKHG4
  Gene Name: pleckstrin homology domain containing, family G (with RhoGef domain) member 4
  Uniprot ID: Q58EX7
  ENSP ID: ENSP00000398030
MERPLENGDESPDSQGHATDWRFAVCSFRDAWEEEEPASQMHVKDPGPPRPPAGATQDEELQGSPLSRKFQLPPAADESGDAQRGTVESSSVLSEGPGPSGVESLLCPMSSHLSLAQGTRDVQGRAVLLLCAHSPAWLQSECSSQELIRLLLYLRSIPRPEVQALGLTVLVDARICAPSSSLFSGLSQLQEAAPGAVYQVLLVGSTLLKEVPSGLQLEQLPSQSLLTHIPTAGLPTSLGGGLPYCHQAWLDFRRRLEALLQNCQAACALLQGAIESVKAVPQPMEPGEVGQLLQQTEVLMQQVLDSPWLAWLQCQGGRELTWLKQEVPEVTLSPDYRTAMDKADELYDRVDGLLHQLTLQSNQRIQALELVQTLEARESGLHQIEVWLQQVGWPALEEAGEPSLDMLLQAQGSFQELYQVAQEQVRQGEKFLQPLTGWEAAELDPPGARFLALRAQLTEFSRALAQRCQRLADAERLFQLFREALTWAEEGQRVLAELEQERPGVVLQQLQLHWTRHPDLPPAHFRKMWALATGLGSEAIRQECRWAWARCQDTWLALDQKLEASLKLPPVGSTASLCVSQVPAAPAHPPLRKAYSFDRNLGQSLSEPACHCHHAATIAACRRPEAGGGALPQASPTVPPPGSSDPRSLNRLQLVLAEMVATEREYVRALEYTMENYFPELDRPDVPQGLRGQRAHLFGNLEKLRDFHCHFFLRELEACTRHPPRVAYAFLRHRVQFGMYALYSKNKPRSDALMSSYGHTFFKDKQQALGDHLDLASYLLKPIQRMGKYALLLQELARACGGPTQELSALREAQSLVHFQLRHGNDLLAMDAIQGCDVNLKEQGQLVRQDEFVVRTGRHKSVRRIFLFEELLLFSKPRHGPTGVDTFAYKRSFKMADLGLTECCGNSNLRFEIWFRRRKARDTFVLQASSLAIKQAWTADISHLLWRQAVHNKEVRMAEMVSMGVGNKAFRDIAPSEEAINDRTVNYVLKCREVRSRASIAVAPFDHDSLYLGASNSLPGDPASCSVLGSLNLHLYRDPALLGLRCPLYPSFPEEAALEAEAELGGQPSLTAEDSEISSQCPSASGSSGSDSSCVSGQALGRGLEDLPCV

SEQ ID NO: 64133 - protein, 1191 aa, Homo sapiens; identical to SEQ ID NO: 64130
  Payload ID: 12798
  Gene Symbol: PLEKHG4
  Gene Name: pleckstrin homology domain containing, family G (with RhoGef domain) member 4
  Uniprot ID: Q58EX7
  ENSP ID: ENSP00000401118

SEQ ID NO: 64134 - protein, 76 aa, Homo sapiens
  Payload ID: 12798
  Gene Symbol: PLEKHG4
  Gene Name: pleckstrin homology domain containing, family G (with RhoGef domain) member 4
  ENSP ID: ENSP00000454348
MERPLENGDESPDSQGHATDWRFAVCSFRDAWEEEEPASQMHVKDPGPPRPPAGATQDEELQGSPLSRKFQLPPAA

SEQ ID NO: 64135 - protein, 106 aa, Homo sapiens
  Payload ID: 12798
  Gene Symbol: PLEKHG4
  Gene Name: pleckstrin homology domain containing, family G (with RhoGef domain) member 4
  ENSP ID: ENSP00000455228
  MOD_RES (1)..(1): Any amino acid
XDIAPSEEAINDRTVNYVLKCREVRSRASIAVAPFDHDSLYLGASNSLPGDPASCSVLGSLNLHLYRDPALLGLRCPLYPSFPEEAALEAEAELGGQPSLISLPSC

SEQ ID NO: 64136 - protein, 73 aa, Homo sapiens
  Payload ID: 12798
  Gene Symbol: PLEKHG4
  Gene Name: pleckstrin homology domain containing, family G (with RhoGef domain) member 4
  ENSP ID: ENSP00000455423
MERPLENGDESPDSQGHATDWRFAVCSFRDAWEEEEPASQMHVKDPGPPRPPAGATQDEELQGSPLSRKFQLP

SEQ ID NO: 64137 - protein, 64 aa, Homo sapiens
  Payload ID: 12798
  Gene Symbol: PLEKHG4
  Gene Name: pleckstrin homology domain containing, family G (with RhoGef domain) member 4
  ENSP ID: ENSP00000455622
MERPLENGDESPDSQGHATDWRFAVCSFRDAWEEEEPASQMHVKDPGTRDVQGRAVLLLCAHSP

SEQ ID NO: 64138 - protein, 77 aa, Homo sapiens
  Payload ID: 12798
  Gene Symbol: PLEKHG4
  Gene Name: pleckstrin homology domain containing, family G (with RhoGef domain) member 4
  ENSP ID: ENSP00000455740
MERPLENGDESPDSQGHATDWRFAVCSFRDAWEEEEPASQMHVKDPGPPRPPAGATQDEELQGSPLSRKFQLPPAAD

SEQ ID NO: 64139 - protein, 108 aa, Homo sapiens
  Payload ID: 12798
  Gene Symbol: PLEKHG4
  Gene Name: pleckstrin homology domain containing, family G (with RhoGef domain) member 4
  ENSP ID: ENSP00000455876
MERPLENGDESPDSQGHATDWRFAVCSFRDAWEEEEPASQMHVKDPGPPRPPAGATQDEELQGSPLSRKFQLPPAADESGDAQRGTVESSSVLSEGPGPSGVESLLCP

SEQ ID NO: 64140 - protein, 36 aa, Homo sapiens
  Payload ID: 12798
  Gene Symbol: PLEKHG4
  Gene Name: pleckstrin homology domain containing, family G (with RhoGef domain) member 4
  ENSP ID: ENSP00000456873
MERPLENGDESPDSQGHATDWRFAVCSFRDAWEEEE

SEQ ID NO: 64141 - protein, 193 aa, Homo sapiens
  Payload ID: 12798
  Gene Symbol: PLEKHG4
  Gene Name: pleckstrin homology domain containing, family G (with RhoGef domain) member 4
  Uniprot ID: Q58EX7
  ENSP ID: ENSP00000457086
MERPLENGDESPDSQGHATDWRFAVCSFRDAWEEEEPASQMHVKDPGPPRPPAGATQDEELQGSPLSRKFQLPPAADESGDAQRGTVESSSVLSEGPGPSGVESLLCPMSSHLSLAQGESDTPGVGLVGDPGPSRAMPSGLSPGALDSDPVGLGDPLSEISKLLEAGKEGWAREVWEGNGDAWRDECQDFGGL

SEQ ID NO: 64142 - protein, 193 aa, Homo sapiens; identical to SEQ ID NO: 64141
  Payload ID: 12798
  Gene Symbol: PLEKHG4
  Gene Name: pleckstrin homology domain containing, family G (with RhoGef domain) member 4
  Uniprot ID: Q58EX7
  ENSP ID: ENSP00000462601

SEQ ID NO: 64143 - protein, 125 aa, Homo sapiens
  Payload ID: 12798
  Gene Symbol: PLEKHG4
  Gene Name: pleckstrin homology domain containing, family G (with RhoGef domain) member 4
  ENSP ID: ENSP00000464631
VRMAEMVSMGVGNKAFRDIAPSEEAINDRTVNYVLKCREVRSRASIAVAPFDHDSLYLGASNSLPGDPASCSVLGSLNLHLYRDPALLGLRCPLYPSFPEEAALEAEAELGGQPSLSLSPGLDEQ

SEQ ID NO: 64144 - protein, 1271 aa, Homo sapiens
  Payload ID: 12799
  Gene Symbol: PLEKHG4B
  Gene Name: pleckstrin homology domain containing, family G (with RhoGef domain) member 4B
  Uniprot ID: Q96PX9
  ENSP ID: ENSP00000283426
MEALRNPMPLGSSEEALGDLACSSLTGASRDLGTGAVASGTQEETSGPRGDPQQTPSLEKERHTPSRTGPGAAGRTLPRRSRSWERAPRSSRGAQAAACHTSHHSAGSRPGGHLGGQAVGTPNCVPVEGPGCTKEEDVLASSACVSTDGGSLHCHNPSGPSDVPARQPHPEQEGWPPGTGDFPSQVPKQVLDVSQELLQSGVVTLPGTRDRHGRAVVQVRTRSLLWTREHSSCAELTRLLLYFHSIPRKEVRDLGLVVLVDARRSPAAPAVSQALSGLQNNTSPIIHSILLLVDKESAFRPDKDAIIQCEVVSSLKAVHKFVDSCQLTADLDGSFPYSHGDWICFRQRLEHFAANCEEAIIFLQNSFCSLNTHRTPRTAQEVAELIDQHETMMKLVLEDPLLVSLRLEGGTVLARLRREELGTEDSRDTLEAATSLYDRVDEEVHRLVLTSNNRLQQLEHLRELASLLEGNDQQSCQKGLQLAKENPQRTEEMVQDFRRGLSAVVSQAECREGELARWTRSSELCETVSSWMGPLDPEACPSSPVAECLRSCHQEATSVAAEAFPGAGVAVLKPHALGKPWASQQDLWLQYPQTRLRLEEALSEAAPDPSLPPLAQSPPKHERAQEAMRRHQKPPSFPSTDSGGGAWEPAQPLSGLPGRALLCGQDGETLRPGLCALWDPLSLLRGLPGAGATTAHLEDSSACSSEPTQTLASRPRKHPQKKMIKKTQSFEIPQPDSGPRDSCQPDHTSVFSKGLEVTSTVATEKKLPLWQHARSPPVTQSRSLSSPSGLHPAEEDGRQQVGSSRLRHIMAEMIATEREYIRCLGYVIDNYFPEMERMDLPQGLRGKHHVIFGNLEKLHDFHQQHFLRELERCQHCPLAVGRSFLRHEEQFGMYVIYSKNKPQSDALLSSHGNAFFKDKQRELGDKMDLASYLLRPVQRVAKYALLLQDLLKEASCGLAQGQELGELRAAEVVVCFQLRHGNDLLAMDAIRGCDVNLKEQGQLRCRDEFIVCCGRKKYLRHVFLFEDLILFSKTQKVEGSHDVYLYKQSFKTAEIGMTENVGDSGLRFEIWFRRRRKSQDTYILQASSAEVKSAWTDVIGRILWRQALKSRELRIQEMASMGIGNQPFMDVKPRDRTPDCAVISDRAPKCAVMSDRVPDSIVKGTESQMRGSTAVSSSDHAAPFKRPHSTISDSSTSSSSSQSSSILGSLGLLVSSSPAHPGLWSPAHSPWSSDIRACVEEDEPEPELETGTQAAVCEGAPAVLLSRTRQA

SEQ ID NO: 64145 - protein, 421 aa, Homo sapiens
  Payload ID: 12799
  Gene Symbol: PLEKHG4B
  Gene Name: pleckstrin homology domain containing, family G (with RhoGef domain) member 4B
  ENSP ID: ENSP00000422493
APRSSRGAQAAACHTSHHSAGSRPGGHLGGQAVGTPNCVPVEGPGCTKEEDVLASSACVSTDGGSLHCHNPSGPSDVPARQPHPEQEGWPPGTGDFPSQVPKQVLDVSQELLQSGVVTLPGTRDRHGRAVVQVRTRSLLWTREHSSCAELTRLLLYFHSIPRKEVRDLGLVVLVDARRSPAAPAVSQALSGLQNNTSPIIHSILLLVDKESAFRPDKDAIIQCEVVSSLKAVHKFVDSCQLTADLDGSFPYSHGDWICFRQRLEHFAANCEEAIIFLQNSFCSLNTHRTPRTAQEVAELIDQHETMMKLVLEDPLLVSLRLEGGTVLARLRREELGTEDSRDTLEAATSLYDRVDEEVHRLVLTSNNRLQQLEHLRELASLLEGNDQVRAAGGRRPGQHPLQARLAKATLSPSHCVFRALI

SEQ ID NO: 64146 - protein, 1006 aa, Homo sapiens
  Payload ID: 12800
  Gene Symbol: PLEKHG5
  Gene Name: pleckstrin homology domain containing, family G (with RhoGef domain) member 5
  Uniprot ID: O94827
  ENSP ID: ENSP00000344570
MHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 64147 - protein, 930 aa, Homo sapiens
  Payload ID: 12800
  Gene Symbol: PLEKHG5
  Gene Name: pleckstrin homology domain containing, family G (with RhoGef domain) member 5
  Uniprot ID: O94827
  ENSP ID: ENSP00000366954
MHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPAQEADPGPALPNQDHPAA

SEQ ID NO: 64148 - protein, 1006 aa, Homo sapiens; identical to SEQ ID NO: 64146
  Payload ID: 12800
  Gene Symbol: PLEKHG5
  Gene Name: pleckstrin homology domain containing, family G (with RhoGef domain) member 5
  Uniprot ID: O94827
  ENSP ID: ENSP00000366957

SEQ ID NO: 64149 - protein, 1043 aa, Homo sapiens
  Payload ID: 12800
  Gene Symbol: PLEKHG5
  Gene Name: pleckstrin homology domain containing, family G (with RhoGef domain) member 5
  Uniprot ID: O94827
  ENSP ID: ENSP00000366961
MDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 64150 - protein, 852 aa, Homo sapiens
  Payload ID: 12800
  Gene Symbol: PLEKHG5
  Gene Name: pleckstrin homology domain containing, family G (with RhoGef domain) member 5
  ENSP ID: ENSP00000366969
MNSVLTKHGSPPRSWLSLCSGTDDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHWKLTLAQLYRIRTTLLLNSTLTASEV

SEQ ID NO: 64151 - protein, 1083 aa, Homo sapiens
  Payload ID: 12800
  Gene Symbol: PLEKHG5
  Gene Name: pleckstrin homology domain containing, family G (with RhoGef domain) member 5
  Uniprot ID: O94827
  ENSP ID: ENSP00000366977
MNSVLTKHGSPPRSWLSLCSGTDDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 64152 - protein, 1006 aa, Homo sapiens; identical to SEQ ID NO: 64146
  Payload ID: 12800
  Gene Symbol: PLEKHG5
  Gene Name: pleckstrin homology domain containing, family G (with RhoGef domain) member 5
  Uniprot ID: O94827
  ENSP ID: ENSP00000383704

SEQ ID NO: 64153 - protein, 1062 aa, Homo sapiens
  Payload ID: 12800
  Gene Symbol: PLEKHG5
  Gene Name: pleckstrin homology domain containing, family G (with RhoGef domain) member 5
  Uniprot ID: O94827
  ENSP ID: ENSP00000383706
MDDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 64154 - protein, 1085 aa, Homo sapiens
  Payload ID: 12800
  Gene Symbol: PLEKHG5
  Gene Name: pleckstrin homology domain containing, family G (with RhoGef domain) member 5
  Uniprot ID: O94827
  ENSP ID: ENSP00000439625
MSLGERGSPQTFGGSSVSKGSDAGHDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 64155 - protein, 1075 aa, Homo sapiens
  Payload ID: 12800
  Gene Symbol: PLEKHG5
  Gene Name: pleckstrin homology domain containing, family G (with RhoGef domain) member 5
  Uniprot ID: O94827
  ENSP ID: ENSP00000441445
MGTGPGVSGRLAASRPGPGLPLRDSEPSWAGGRARDGDSQVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 64156 - protein, 790 aa, Homo sapiens
  Payload ID: 12801
  Gene Symbol: PLEKHG6
  Gene Name: pleckstrin homology domain containing, family G (with RhoGef domain) member 6
  Uniprot ID: Q3KR16
  ENSP ID: ENSP00000011684
MKAFGPPHEGPLQGLVASRIETYGGRHRASAQSTAGRLYPRGYPVLDPSRRRLQQYVPFARGSGQARGLSPMRLRDPEPEKRHGGHVGAGLLHSPKLKELTKAHELEVRLHTFSMFGMPRLPPEDRRHWEIGEGGDSGLTIEKSWRELVPGHKEMSQELCHQQEALWELLTTELIYVRKLKIMTDLLAAGLLNLQRVGLLMEVSAETLFGNVPSLIRTHRSFWDEVLGPTLEETRASGQPLDPIGLQSGFLTFGQRFHPYVQYCLRVKQTMAYAREQQETNPLFHAFVQWCEKHKRSGRQMLCDLLIKPHQRITKYPLLLHAVLKRSPEARAQEALNAMIEAVESFLRHINGQVRQGEEQESLAAAAQRIGPYEVLEPPSDEVEKNLRPFSTLDLTSPMLGVASEHTRQLLLEGPVRVKEGREGKLDVYLFLFSDVLLVTKPQRKADKAKVIRPPLMLEKLVCQPLRDPNSFLLIHLTEFQCVSSALLVHCPSPTDRAQWLEKTQQAQAALQKLKAEEYVQQKRELLTLYRDQDRESPSTRPSTPSLEGSQSSAEGRTPEFSTIIPHLVVTEDTDEDAPLVPDDTSDSGYGTLIPGTPTGSRSPLSRLRQRALRRDPRLTFSTLELRDIPLRPHPPDPQAPQRRSAPELPEGILKGGSLPQEDPPTWSEEEDGASERGNVVVETLHRARLRGQLPSSPTHADSAGESPWESSGEEEEEGPLFLKAGHTSLRPMRAEDMLREIREELASQRIEGAEEPRDSRPRKLTRAQLQRMRGPHIIQLDTPLSASEV

SEQ ID NO: 64157 - protein, 320 aa, Homo sapiens
  Payload ID: 12801
  Gene Symbol: PLEKHG6
  Gene Name: pleckstrin homology domain containing, family G (with RhoGef domain) member 6
  Uniprot ID: Q3KR16
  ENSP ID: ENSP00000304640
MCPREGGRASTIHQKTEKAFGQLLCQPLGEPKIQHPLKAALQKLKAEEYVQQKRELLTLYRDQDRESPSTRPSTPSLEGSQSSAEGRTPEFSTIIPHLVVTEDTDEDAPLVPDDTSDSGYGTLIPGTPTGSRSPLSRLRQRALRRDPRLTFSTLELRDIPLRPHPPDPQAPQRRSAPELPEGILKGGSLPQEDPPTWSEEEDGASERGNVVVETLHRARLRGQLPSSPTHADSAGESPWESSGEEEEEGPLFLKAGHTSLRPMRAEDMLREIREELASQRIEGAEEPRDSRPRKLTRAQLQRMRGPHIIQLDTPLSASEV

SEQ ID NO: 64158 - protein, 790 aa, Homo sapiens; identical to SEQ ID NO: 64156
  Payload ID: 12801
  Gene Symbol: PLEKHG6
  Gene Name: pleckstrin homology domain containing, family G (with RhoGef domain) member 6
  Uniprot ID: Q3KR16
  ENSP ID: ENSP00000380185

SEQ ID NO: 64159 - protein, 758 aa, Homo sapiens
  Payload ID: 12801
  Gene Symbol: PLEKHG6
  Gene Name: pleckstrin homology domain containing, family G (with RhoGef domain) member 6
  Uniprot ID: Q3KR16
  ENSP ID: ENSP00000393194
MGCRLHAPGEKAAHDPSRRRLQQYVPFARGSGQARGLSPMRLRDPEPEKRHGGHVGAGLLHSPKLKELTKAHELEVRLHTFSMFGMPRLPPEDRRHWEIGEGGDSGLTIEKSWRELVPGHKEMSQELCHQQEALWELLTTELIYVRKLKIMTDLLAAGLLNLQRVGLLMEVSAETLFGNVPSLIRTHRSFWDEVLGPTLEETRASGQPLDPIGLQSGFLTFGQRFHPYVQYCLRVKQTMAYAREQQETNPLFHAFVQWCEKHKRSGRQMLCDLLIKPHQRITKYPLLLHAVLKRSPEARAQEALNAMIEAVESFLRHINGQVRQGEEQESLAAAAQRIGPYEVLEPPSDEVEKNLRPFSTLDLTSPMLGVASEHTRQLLLEGPVRVKEGREGKLDVYLFLFSDVLLVTKPQRKADKAKVIRPPLMLEKLVCQPLRDPNSFLLIHLTEFQCVSSALLVHCPSPTDRAQWLEKTQQAQAALQKLKAEEYVQQKRELLTLYRDQDRESPSTRPSTPSLEGSQSSAEGRTPEFSTIIPHLVVTEDTDEDAPLVPDDTSDSGYGTLIPGTPTGSRSPLSRLRQRALRRDPRLTFSTLELRDIPLRPHPPDPQAPQRRSAPELPEGILKGGSLPQEDPPTWSEEEDGASERGNVVVETLHRARLRGQLPSSPTHADSAGESPWESSGEEEEEGPLFLKAGHTSLRPMRAEDMLREIREELASQRIEGAEEPRDSRPRKLTRAQLQRMRGPHIIQLDTPLSASEV

SEQ ID NO: 64160 - protein, 495 aa, Homo sapiens
  Payload ID: 12801
  Gene Symbol: PLEKHG6
  Gene Name: pleckstrin homology domain containing, family G (with RhoGef domain) member 6
  ENSP ID: ENSP00000442836
MKAFGPPHEGPLQGLVASRIETYGGRHRASAQSTAGRLYPRGYPVLDPSRRRLQQYVPFARGSGQARGLSPMRLRDPEPEKRHGGHVGAGLLHSPKLKELTKAHELEVRLHTFSMFGMPRLPPEDRRHWEIGEGGDSGLTIEKSWRELVPGHKEMSQELCHQQEALWELLTTELIYVRKLKIMTDLLAAGLLNLQRVGLLMEVSAETLFGNVPSLIRTHRSFWDEVLGPTLEETRASGQPLDPIGLQSGFLTFGQRFHPYVQYCLRVKQTMAYAREQQETNPLFHAFVQWCEKHKRSGRQMLCDLLIKPHQRITKYPLLLHAVLKRSPEARAQEALNAMIEAVESFLRHINGQVRQGEEQESLAAAAQRIGPYEVLEPPSDEVEKNLRPFSTLDLTSPMLGVASEHTRQLLLEGPVRVKEGREGKLDVYLFLFSDVLLVTKPQRKADKAKVIRPPLMLEKLVCQPLRDPSTSFLQGVFSSPSSQRGEGGAGTEIK

SEQ ID NO: 64161 - protein, 379 aa, Homo sapiens
  Payload ID: 12802
  Gene Symbol: PLEKHG7
  Gene Name: pleckstrin homology domain containing, family G (with RhoGef domain) member 7
  Uniprot ID: Q6ZR37
  ENSP ID: ENSP00000344961
MIFMNTLRYLQTHEYLLDVDLWRLFANLEELTQTSLGFVNSLFGIIKDYVDASEISSSLDFISVLTKYFRGSLCQSHQTYCLNYSAAIFYLESLRQRDDFGIYLKWCEQNEQCRRLHVPELLVAPLQRLTRYPLLLKNIWKRSMDSAEKIMIYSIKEKVEKSIRDLEGKVKWLDNFQKFRYLQEIIVWPPLWDRDKRFFIPECLKHIFKEHMAENILSPTSRHLLYEGKLTLAESTRFLDVYLFLFNDFLLVTKTKCNKKKLGGSDPGLMCPSLTPELQAVIKEGGSCTVLDQPIPLDRLVVKSIEPLHVSVFGLRNAFLIQHENRYRQCIAAFLLQAQTENIKKTWMAQITTAISCFTKSQETKKISLFTLPAESSEI

SEQ ID NO: 64162 - protein, 126 aa, Homo sapiens
  Payload ID: 12802
  Gene Symbol: PLEKHG7
  Gene Name: pleckstrin homology domain containing, family G (with RhoGef domain) member 7
  ENSP ID: ENSP00000473287
MIFMNTLRYLQTHEYLLDVDLWRLFANLEELTQTSLGFVNSLFGIIKDYVDASEISSSLDFISVLTKYFRGSLCQSHQTYCLNYSAAIFYLESLRQRDDFGIYLKKQNDAEEETGNFVPSLFVWHN

SEQ ID NO: 64163 - protein, 1364 aa, Homo sapiens
  Payload ID: 12803
  Gene Symbol: PLEKHH1
  Gene Name: pleckstrin homology domain containing, family H (with MyTH4 domain) member 1
  Uniprot ID: Q9ULM0
  ENSP ID: ENSP00000330278
MAELKVEAPASVDWQKRCLTLETQLFRFRLQASKIRELLADKMQELEQRLLEAEQRAENAETQVGVMEEKVKLSNLKNVDSEGSLHRKYQELLKAIKGKDELISQLEAQLEKQKQMRAEEAKTVQEKAAKIKEWVTLKLAKLEMENQHLKSHNQRLVEQVGSLQDALEAIQIAPSRKLLVPPYGAAEQDSVPSEPGIQPMGQDSGSQAQGLKAAVLAPSPGALQSKDSVSEAASPLEDSSSSTVHSGETVEAKPLQPHLGRESPPHQPCMKLLTFRCSSASWGEGLVTAQRGMLPGTKTSAREGGPGSSLTLPKVRAPGTPRDSIQLAKRHHSQPQVGHGHFGRVVNIETEAFSALHPSGLPELESRARSREEPEKMEMEEPPPAGKNEERESPKALGAELEEVELGNKPPTPPLHQFSSWESRIYAVATSGMRLSDMSPRSNTACCASSPPALVSPGSFSGLVYKNVTVPVYTALKGRATQISNMPFMDESSGSDDDCSSQASFRISVPSSESRKTSGLGSPRAIKRGVSMSSLSSEGDYAIPPDACSLDSDYSEPEHKLQRTSSYSTDGLGLGGESLEKSGYLLKMGSQVKTWKRRWFVLRQGQIMYYKSPSDVIRKPQGQVDLNSRCQIVRGEGSQTFQLISEKKTYYLTADSPSLLEEWIRVLQSLLKVQATGPPALLRGGTKPTVKGWLTKVKHGHSKVVWCALVGKIFYYYRSHEDKRPLGCLPVRDAHIEEVDRSCDSDEDYEAGGTRRLLSSHCTLVIHPTEHSPTYLLIGTKHEKDTWLYHLTVAAGGSSAKVGTAYEQLIGKLMDGEGDPDSPLWRHPMLCYSKDGLYASLTTLPSEALQTEALKLFKSCQLFINVPVEAASVDYHVSLAQTALQVCLVHPELQSEIYCQLMKQTSCRPPQKYSLMQCWQLLALCAPLFLPQHHFLWYVKQQLQRHADPRSETGQYATYCQRAVERTLRTGEREARPSRMEVVSILLRNPFHHSLPFSIPVHFTNGTYHVVGFDGSSTVDEFLQRLNQEIGMRKPSHSGFALFTDDPSGRDLEHCLQGSVKICDAISKWEQAMKELHPGKSEGGTRVVKLMYKNRLYFRSQVKGETDRERLLLASQTSREIVAGRFPINKELALEMAALMAQVEYGDLEKPALPGPGGTSPAKAQHLLQQVLDRFHPRRYRHGAPAEQLRHLADMLTTKWATLQGCSPPECIRIYLTVARKWPFFGAKLFAAQPAQLSSKENALVWIAVNEDGVSILDHNTMQVHITYPYSSVTTFGGCRDDFMLVIRSIPDKSSGKSHIEKLIFRMAAPKIAEATFIMASYMNHCTTTVNPPTNPPGACQLWELDGRQFFSSVSCATKGPTLL

SEQ ID NO: 64164 - protein, 182 aa, Homo sapiens
  Payload ID: 12803
  Gene Symbol: PLEKHH1
  Gene Name: pleckstrin homology domain containing, family H (with MyTH4 domain) member 1
  ENSP ID: ENSP00000452988
  MOD_RES (1)..(1): Any amino acid
XLFLPQHHFLWYVKQQLQRHADPRSETGQYATYCQRAVERTLRTGEREARPSRMEVVSILLRNPFHHSLPFSIPVHFTNGTYHVVGFDGSSTVDEFLQRLNQEIGMRKPSHSGFALFTDDPSGRDLEHCLQGSVKICDAISKWEQAMKELHPGKSEGCTFAVKSKGRRTENGCSLPLKPVER

SEQ ID NO: 64165 - protein, 34 aa, Homo sapiens
  Payload ID: 12803
  Gene Symbol: PLEKHH1
  Gene Name: pleckstrin homology domain containing, family H (with MyTH4 domain) member 1
  ENSP ID: ENSP00000453343
  MOD_RES (1)..(1): Any amino acid
XFAAQPAQLSSKENALVWIAVNEDGVSILDHNTM

SEQ ID NO: 64166 - protein, 81 aa, Homo sapiens
  Payload ID: 12803
  Gene Symbol: PLEKHH1
  Gene Name: pleckstrin homology domain containing, family H (with MyTH4 domain) member 1
  ENSP ID: ENSP00000453699
  MOD_RES (1)..(1): Any amino acid
XLVIRSIPDKSSGKSHIEKLIFRMAAPKIAEATFIMASYMNHCTTTVNPPTNPPGACQLWELDGRQFFSSVSCATKGPTLL

SEQ ID NO: 64167 - protein, 1493 aa, Homo sapiens
  Payload ID: 12804
  Gene Symbol: PLEKHH2
  Gene Name: pleckstrin homology domain containing, family H (with MyTH4 domain) member 2
  Uniprot ID: Q8IVE3
  ENSP ID: ENSP00000282406
MAELSEPEGPVDWKERCVALESQLMKFRVQASKIRELLAEKMQQLERQVIDAERQAEKAFQQVQVMEDKLKAANIQTSESETRLYNKCQDLESLIQEKDDVIQNLELQLEEQKQIRIQEAKIIEEKAAKIKEWVTVKLNELELENQNLRLINQNQTEEIRTMQSKLQEVQGKKSSTVSTLKLSEGQRLSSLTFGCFLSRARSPPQVVKSEEMSKISSKEPEFTEGKDMEEMEIPEKSVDNQVLENNRGQRTLHQTPCGSEQNRKTRTSFATDGGISQNSGAPVSDWSSDEEDGSKGRSKSRCTSTLSSHTSEEGVQCSRMGSEMYLTASDDSSSIFEEETFGIKRPEHKKLYSWQQEAQWKALNSPLGKGNSELSKKEQDSSSDELNKKFQSQRLDYSSSSSEANTPSPILTPALMPKHPNSLSGKGTQLVPSSHLPPPKLRIPNVFSISVALAKRHLSQPQLSSDRMFGTNRNAISMIRPLRPQETDLDLVDGDSTEVLENMDTSCDDGLFSYDSLDSPNSDDQEHCDSAKKVAYSKPPTPPLHRFPSWESRIYAVAKSGIRMSEAFNMESVNKNSAATLSYTTSGLYTSLIYKNMTTPVYTTLKGKATQISSSPFLDDSSGSEEEDSSRSSSRTSESDSRSRSGPGSPRAMKRGVSLSSVASESDYAIPPDAYSTDTEYSQPEQKLPKTCSSSSDNGKNEPLEKSGYLLKMSGKVKSWKRRWFVLKGGELLYYKSPSDVIRKPQGHIELSASCSILRGDNKQTVQLTTEKHTYYLTADSPNILEEWIKVLQNVLRVQAANPLSLQPEGKPTMKGLLTKVKHGYSKRVWCTLIGKTLYYFRSQEDKFPLGQIKLWEAKVEEVDRSCDSDEDYEASGRSLLSTHYTIVIHPKDQGPTYLLIGSKHEKDTWLYHLTVAAGSNNVNVGSEFEQLVCKLLNIDGEPSSQIWRHPTLCHSKEGIISPLTTLPSEALQTEAIKLFKTCQLFINAAVDSPAIDYHISLAQSALQICLTHPELQNEICCQLIKQTRRRQPQNQPGPLQGWQLLALCVGLFLPHHPFLWLLRLHLKRNADSRTEFGKYAIYCQRCVERTQQNGDREARPSRMEILSTLLRNPYHHSLPFSIPVHFMNGIYQVVGFDASTTVEEFLNTLNQDTGMRKPAQSGFALFTDDPSGRDLEHCLQGNIKICDIISKWEQASKEQQPGKCEGTRTVRLTYKNRLYFSVQARGETDREKLLLMYQTNDQIINGLFPLNKDLALEMAALLSQVEIGDFERPFSTPAGHVTNQCKVNQTLKQVIEKFYPKRYRDGCSEEQLRQLCQRLSTRWMALRGHSAADCVRIYLTVARKWPFFGAKLFLAKPITPSSLGSTFLWLAVHEDGLSLLEYNSMRLIVSYVYKSLMTFGGYQDDFMVVINNTHSKDKPTEKLLFAMAKPKILEITLLIASYINNFHQQKAAFHHLSAPALLSAQTRGPQARMMGSQPLLSSSRPTKGPTLL

SEQ ID NO: 64168 - protein, 89 aa, Homo sapiens
  Payload ID: 12804
  Gene Symbol: PLEKHH2
  Gene Name: pleckstrin homology domain containing, family H (with MyTH4 domain) member 2
  ENSP ID: ENSP00000427746
MAELSEPEGPVDWKERCVALESQLMKFRVQASKIRELLAEKMQQLERQVIDAERQAEKAFQQTESCSVAQAGVQWRDLGLLQPPPPGFK

SEQ ID NO: 64169 - protein, 88 aa, Homo sapiens
  Payload ID: 12804
  Gene Symbol: PLEKHH2
  Gene Name: pleckstrin homology domain containing, family H (with MyTH4 domain) member 2
  ENSP ID: ENSP00000430377
SKEQQPGKCEGTRTVRLTYKNRLYFSVQARGETDREKLLLMYQTNDQIINGLFPLNKDLALEMAALLSQAALPATFNQMDGPPGTQCC

SEQ ID NO: 64170 - protein, 790 aa, Homo sapiens
  Payload ID: 12805
  Gene Symbol: PLEKHH3
  Gene Name: pleckstrin homology domain containing, family H (with MyTH4 domain) member 3
  ENSP ID: ENSP00000293349
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRKETGLWSVTVSGRKHSVRLCSPRQAEAERWGVALREVIASKAPLETPTQLLLRDIQESCGDPEAVALIYLRNPILRHTSGALYAPLLPLPYGVSAPGPGYAPLREEAVRLFLALQALEGARRPGPLMQGVLQTCRDLPALRDELFLQLAKQTSGPAGPPGLPATQDPAALRYWQLLTCMSCTFRPGGAVRGHLLGHLERTEQALPDSELAEYARFIRKALGRTRGRELVPSLAEISALSQRQELLCTVHCPGAGACAVAIDSHTTAGEVARELVGRLGLARSRNAFALYEQRGAQERALAGGTLVADVLTSLAAEEAGLEDSPDSGWRLCLRLHGPLHPEGLSPDGHELPFLFEQAHALLLRGRPPPPDDTLRALAALRLQSLQRDFSPRVPLPRLDRLLPPPAPPREDPPRPTPRPPPSAALLAGALWSPGLAKRRAERARRGGAGRTAGSIAREGGGGAGTAAAVLGGWKRLRGMGRAEAMAAYLALAAQCPGFGAARYDVLELSTEPGRGAPQKLCLGLGAKAMSLSRPGETEPIHSVSYGHVAACQLMGPHTLALRVGESQLLLQSPQVEEIMQLVNAYLANPSPERPCSSSSPPCQDLPDTSPPSQRPGLDEPQGQSGCLGQLQD

SEQ ID NO: 64171 - protein, 206 aa, Homo sapiens
  Payload ID: 12805
  Gene Symbol: PLEKHH3
  Gene Name: pleckstrin homology domain containing, family H (with MyTH4 domain) member 3
  ENSP ID: ENSP00000465400
MPLPGGLWWLLCCRRGFTLLHRDYGDGELSGDGDEDEDEETFELRTPSPAGGGRGGSVEEGKMRRRGCLGAWQNELTSPVSKMGKLRPGDGKRLAQGSTGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRK

SEQ ID NO: 64172 - protein, 705 aa, Homo sapiens
  Payload ID: 12805
  Gene Symbol: PLEKHH3
  Gene Name: pleckstrin homology domain containing, family H (with MyTH4 domain) member 3
  Uniprot ID: Q7Z736
  ENSP ID: ENSP00000467824
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRKETGLWSVTVSGRKHSVRLCSPRQAEAERWGVALREVIASKAPLETPTQLLLRDIQESCGDPEAVALIYLRNPILRHTSGALYAPLLPLPYGVSAPGPGYAPLREEAVRLFLALQALEGARRPGPLMQGVLQTCRDLPALRDELFLQLAKQTSGPAGPPGLPATQDPAALRYWQLLTCMSCTFRPGGAVRGHLLGHLERTEQALPDSELAEYARFIRKALGRTRGRELVPSLAEISALSQRQELLCTVHCPGAGACAVAIDSHTTAGEVARELVGRLGLARSRNAFALYEQRGAQERALAGGTLVADVLTRFENLAAEEAGLEDSPDSGWRLCLRLHGPLHPEGLSPDGHELPFLFEQAHALLLRGRPPPPDDTLRALAALRLQSLQRDFSPRVPLPRLDRLLPPPAPPREDPPRPTPRPPPSAALLAGALWSPGLAKRRAERARRGGAGRTAGSIAREGGGGAGTAAAVLGGWKRLRGMGRAEAMAAYLALAAQCPGFGAARSLVGVLHRSCAWAWEPRPCPSPGQGRRSPSTVSAMAMWPPAS

SEQ ID NO: 64173 - protein, 793 aa, Homo sapiens
  Payload ID: 12805
  Gene Symbol: PLEKHH3
  Gene Name: pleckstrin homology domain containing, family H (with MyTH4 domain) member 3
  Uniprot ID: Q7Z736
  ENSP ID: ENSP00000468678
MPLPGGLWWLLCCRRGFTLLHRDYGDGELSGDGDEDEDEETFELRTPSPAGGGRGPLEVTLTQPVRSGPVSNRLQSWEETWSLIPEKGLPEDDPDIVVKGWLYREPRGGGARPWLPPRRAWFVLTRDSLDQFSSSGKGARRLGSLVLTSLCSVTGPERRRKETGLWSVTVSGRKHSVRLCSPRQAEAERWGVALREVIASKAPLETPTQLLLRDIQESCGDPEAVALIYLRNPILRHTSGALYAPLLPLPYGVSAPGPGYAPLREEAVRLFLALQALEGARRPGPLMQGVLQTCRDLPALRDELFLQLAKQTSGPAGPPGLPATQDPAALRYWQLLTCMSCTFRPGGAVRGHLLGHLERTEQALPDSELAEYARFIRKALGRTRGRELVPSLAEISALSQRQELLCTVHCPGAGACAVAIDSHTTAGEVARELVGRLGLARSRNAFALYEQRGAQERALAGGTLVADVLTRFENLAAEEAGLEDSPDSGWRLCLRLHGPLHPEGLSPDGHELPFLFEQAHALLLRGRPPPPDDTLRALAALRLQSLQRDFSPRVPLPRLDRLLPPPAPPREDPPRPTPRPPPSAALLAGALWSPGLAKRRAERARRGGAGRTAGSIAREGGGGAGTAAAVLGGWKRLRGMGRAEAMAAYLALAAQCPGFGAARYDVLELSTEPGRGAPQKLCLGLGAKAMSLSRPGETEPIHSVSYGHVAACQLMGPHTLALRVGESQLLLQSPQVEEIMQLVNAYLANPSPERPCSSSSPPCQDLPDTSPPSQRPGLDEPQGQSGCLGQLQD

SEQ ID NO: 64174 - protein, 149 aa, Homo sapiens
  Payload ID: 12806
  Gene Symbol: PLEKHJ1
  Gene Name: pleckstrin homology domain containing, family J member 1
  Uniprot ID: Q9NW61
  ENSP ID: ENSP00000318075
MRYNEKELQALSRQPAEMAAELGMRGPKKGSVLKRRLVKLVVNFLFYFRTDEAEPVGALLLERCRVVREEPGTFSISFIEDPERKYHFECSSEEQCQEWMEALRRASYEFMRRSLIFYRNEIRKVTGKDPLEQFGISEEARFQLSGLQA

SEQ ID NO: 64175 - protein, 150 aa, Homo sapiens
  Payload ID: 12806
  Gene Symbol: PLEKHJ1
  Gene Name: pleckstrin homology domain containing, family J member 1
  ENSP ID: ENSP00000464924
MRYNEKELQALSRQPAEMAAELGMRGPKKGSVLKRRLVKLVVNFLFYFRTDEAEVGASRARGRVPGWAPRRPGAHCPVPAPVSPPARRSPAAGALQSRPGRARHLLHHYEFMRRSLIFYRNEIRKVTGKDPLEQFGISEEARFQLSGLQA

SEQ ID NO: 64176 - protein, 277 aa, Homo sapiens
  Payload ID: 12806
  Gene Symbol: PLEKHJ1
  Gene Name: pleckstrin homology domain containing, family J member 1
  ENSP ID: ENSP00000464955
MRYNEKELQALSRQPAEMAAELGMRGPKKGSVLKRRLVKLVVNFLFYFRTDEAEPVGALLLERCRVVREEPGTFSISFIEDPERKYHFECSSEEQCQEWMEALRRASYEFMRRSLIFYRNEIRKVTGKKHQGTHDRPAPHRRACCEPWTAEKYKSKCTCSTCPRRPHSTIAQHMASCVTAQAPSHARAQPTPRRVNSLGVHSAGVKVKSSGQAPGRSGRGSGRGEASEECGGDGPAFGTGAARRGSRPGGVSENGVRRCQRLVSTKRVEAGAGLGTR

SEQ ID NO: 64177 - protein, 149 aa, Homo sapiens; identical to SEQ ID NO: 64174
  Payload ID: 12806
  Gene Symbol: PLEKHJ1
  Gene Name: pleckstrin homology domain containing, family J member 1
  Uniprot ID: Q9NW61
  ENSP ID: ENSP00000465391

SEQ ID NO: 64178 - protein, 94 aa, Homo sapiens
  Payload ID: 12806
  Gene Symbol: PLEKHJ1
  Gene Name: pleckstrin homology domain containing, family J member 1
  ENSP ID: ENSP00000468257
MRYNEKELQALSRQPAEMAAELGMRGPKKGSVLKRRLVKLVVNFLFYFRTDEAEPVGALLLERCRVVREEPGTFSITTSSCGEASSSTGTKSGR

SEQ ID NO: 64179 - protein, 174 aa, Homo sapiens
  Payload ID: 12806
  Gene Symbol: PLEKHJ1
  Gene Name: pleckstrin homology domain containing, family J member 1
  ENSP ID: ENSP00000468441
MRYNEKELQALSRQPAEMAAELGMRGPKKGSVLKRRLVKLVVNFLFYFRTDEAEPVGALLLERCRVVREEPGTFSISFIEDPERKYHFECSSEEQCQEWMEALRRASYEFMRRSLIFYRNEIRKVTGKVCAGLQRAGVGLQVAEAVLQPWLMATRPPHRTPWNSSAYPRRPGSS

SEQ ID NO: 64180 - protein, 1056 aa, Homo sapiens
  Payload ID: 12807
  Gene Symbol: PLEKHM1
  Gene Name: pleckstrin homology domain containing, family M (with RUN domain) member 1
  Uniprot ID: Q9Y4G2
  ENSP ID: ENSP00000389913
MLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHKHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPKNKSWISEDDFYRPSREQPLESASDHPIASYRGTPGSRPGLHRHFSQEPRKNCSLGALDQACVPSPGRRQAQAAPSQGHKSFRVVHRRQMGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQIADGVYEGFLKALIEFASQHVYHCDLCTQRGFICQICQHHDIIFPFEFDTTVRCAECKTVFHQSCQAVVKKGCPRCARRRKYQEQNIFA

SEQ ID NO: 64181 - protein, 63 aa, Homo sapiens
  Payload ID: 12807
  Gene Symbol: PLEKHM1
  Gene Name: pleckstrin homology domain containing, family M (with RUN domain) member 1
  ENSP ID: ENSP00000394344
MLSVVENGLDPQAAIPTHHLRVGAPDVCQHGCGPLPGMAAAGPERWPDGVLPEAAAAGAGPLA

SEQ ID NO: 64182 - protein, 140 aa, Homo sapiens
  Payload ID: 12807
  Gene Symbol: PLEKHM1
  Gene Name: pleckstrin homology domain containing, family M (with RUN domain) member 1
  ENSP ID: ENSP00000462065
MECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDS

SEQ ID NO: 64183 - protein, 335 aa, Homo sapiens
  Payload ID: 12807
  Gene Symbol: PLEKHM1
  Gene Name: pleckstrin homology domain containing, family M (with RUN domain) member 1
  ENSP ID: ENSP00000462160
MLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHKHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEKTRAGSQRMTSTGLPGSNPWRVLQTTQ

SEQ ID NO: 64184 - protein, 63 aa, Homo sapiens; identical to SEQ ID NO: 64181
  Payload ID: 12807
  Gene Symbol: PLEKHM1
  Gene Name: pleckstrin homology domain containing, family M (with RUN domain) member 1
  ENSP ID: ENSP00000462282

SEQ ID NO: 64185 - protein, 99 aa, Homo sapiens
  Payload ID: 12807
  Gene Symbol: PLEKHM1
  Gene Name: pleckstrin homology domain containing, family M (with RUN domain) member 1
  ENSP ID: ENSP00000464766
MLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHK

SEQ ID NO: 64186 - protein, 45 aa, Homo sapiens
  Payload ID: 12807
  Gene Symbol: PLEKHM1
  Gene Name: pleckstrin homology domain containing, family M (with RUN domain) member 1
  ENSP ID: ENSP00000466589
LCRSGALKELSKRLNHRNYLLESPHRFSVADLQQVRVSCFPRPDL

SEQ ID NO: 64187 - protein, 152 aa, Homo sapiens
  Payload ID: 12807
  Gene Symbol: PLEKHM1
  Gene Name: pleckstrin homology domain containing, family M (with RUN domain) member 1
  ENSP ID: ENSP00000467356
MLSVVENGLDPQAAIPVIKKKLVGSVKALQKQHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKES

SEQ ID NO: 64188 - protein, 113 aa, Homo sapiens
  Payload ID: 12807
  Gene Symbol: PLEKHM1
  Gene Name: pleckstrin homology domain containing, family M (with RUN domain) member 1
  ENSP ID: ENSP00000467695
  MOD_RES (1)..(1): Any amino acid
XKLLGDYLGLCRSGALKELSKRLNHRNYLLESPHRFSVADLQQHVYHCDLCTQRGFICQICQHHDIIFPFEFDTTVRCAECKTVFHQSCQAVVKKGCPRCARRRKYQEQNIFA

SEQ ID NO: 64189 - protein, 1056 aa, Homo sapiens; identical to SEQ ID NO: 64180
  Payload ID: 12807
  Gene Symbol: PLEKHM1
  Gene Name: pleckstrin homology domain containing, family M (with RUN domain) member 1
  Uniprot ID: Q9Y4G2
  ENSP ID: ENSP00000479066

SEQ ID NO: 64190 - protein, 1056 aa, Homo sapiens; identical to SEQ ID NO: 64180
  Payload ID: 12807
  Gene Symbol: PLEKHM1
  Gene Name: pleckstrin homology domain containing, family M (with RUN domain) member 1
  Uniprot ID: Q9Y4G2
  ENSP ID: ENSP00000483820

SEQ ID NO: 64191 - protein, 113 aa, Homo sapiens; identical to SEQ ID NO: 64188
  Payload ID: 12807
  Gene Symbol: PLEKHM1
  Gene Name: pleckstrin homology domain containing, family M (with RUN domain) member 1
  ENSP ID: ENSP00000485796
  MOD_RES (1)..(1): Any amino acid

SEQ ID NO: 64192 - protein, 63 aa, Homo sapiens; identical to SEQ ID NO: 64181
  Payload ID: 12807
  Gene Symbol: PLEKHM1
  Gene Name: pleckstrin homology domain containing, family M (with RUN domain) member 1
  ENSP ID: ENSP00000486041

SEQ ID NO: 64193 - protein, 63 aa, Homo sapiens; identical to SEQ ID NO: 64181
  Payload ID: 12807
  Gene Symbol: PLEKHM1
  Gene Name: pleckstrin homology domain containing, family M (with RUN domain) member 1
  ENSP ID: ENSP00000486792

SEQ ID NO: 64194 - protein, 140 aa, Homo sapiens; identical to SEQ ID NO: 64182
  Payload ID: 12807
  Gene Symbol: PLEKHM1
  Gene Name: pleckstrin homology domain containing, family M (with RUN domain) member 1
  ENSP ID: ENSP00000486818

SEQ ID NO: 64195 - protein, 152 aa, Homo sapiens; identical to SEQ ID NO: 64187
  Payload ID: 12807
  Gene Symbol: PLEKHM1
  Gene Name: pleckstrin homology domain containing, family M (with RUN domain) member 1
  ENSP ID: ENSP00000487016

SEQ ID NO: 64196 - protein, 45 aa, Homo sapiens; identical to SEQ ID NO: 64186
  Payload ID: 12807
  Gene Symbol: PLEKHM1
  Gene Name: pleckstrin homology domain containing, family M (with RUN domain) member 1
  ENSP ID: ENSP00000487292

SEQ ID NO: 64197 - protein, 99 aa, Homo sapiens; identical to SEQ ID NO: 64185
  Payload ID: 12807
  Gene Symbol: PLEKHM1
  Gene Name: pleckstrin homology domain containing, family M (with RUN domain) member 1
  ENSP ID: ENSP00000487306

SEQ ID NO: 64198 - protein, 335 aa, Homo sapiens; identical to SEQ ID NO: 64183
  Payload ID: 12807
  Gene Symbol: PLEKHM1
  Gene Name: pleckstrin homology domain containing, family M (with RUN domain) member 1
  ENSP ID: ENSP00000487342

SEQ ID NO: 64199 - protein, 63 aa, Homo sapiens; identical to SEQ ID NO: 64181
  Payload ID: 12807
  Gene Symbol: PLEKHM1
  Gene Name: pleckstrin homology domain containing, family M (with RUN domain) member 1
  ENSP ID: ENSP00000487597

SEQ ID NO: 64200 - protein, 152 aa, Homo sapiens; identical to SEQ ID NO: 64187
  Payload ID: 12807
  Gene Symbol: PLEKHM1
  Gene Name: pleckstrin homology domain containing, family M (with RUN domain) member 1
  ENSP ID: ENSP00000487707

SEQ ID NO: 64201 - protein, 140 aa, Homo sapiens; identical to SEQ ID NO: 64182
  Payload ID: 12807
  Gene Symbol: PLEKHM1
  Gene Name: pleckstrin homology domain containing, family M (with RUN domain) member 1
  ENSP ID: ENSP00000487784

SEQ ID NO: 64202 - protein, 99 aa, Homo sapiens; identical to SEQ ID NO: 64185
  Payload ID: 12807
  Gene Symbol: PLEKHM1
  Gene Name: pleckstrin homology domain containing, family M (with RUN domain) member 1
  ENSP ID: ENSP00000488009

SEQ ID NO: 64203 - protein, 63 aa, Homo sapiens; identical to SEQ ID NO: 64181
  Payload ID: 12807
  Gene Symbol: PLEKHM1
  Gene Name: pleckstrin homology domain containing, family M (with RUN domain) member 1
  ENSP ID: ENSP00000488346

SEQ ID NO: 64204 - protein, 113 aa, Homo sapiens; identical to SEQ ID NO: 64188
  Payload ID: 12807
  Gene Symbol: PLEKHM1
  Gene Name: pleckstrin homology domain containing, family M (with RUN domain) member 1
  ENSP ID: ENSP00000488358
  MOD_RES (1)..(1): Any amino acid

SEQ ID NO: 64205 - protein, 335 aa, Homo sapiens; identical to SEQ ID NO: 64183
  Payload ID: 12807
  Gene Symbol: PLEKHM1
  Gene Name: pleckstrin homology domain containing, family M (with RUN domain) member 1
  ENSP ID: ENSP00000488497

SEQ ID NO: 64206 - protein, 45 aa, Homo sapiens; identical to SEQ ID NO: 64186
  Payload ID: 12807
  Gene Symbol: PLEKHM1
  Gene Name: pleckstrin homology domain containing, family M (with RUN domain) member 1
  ENSP ID: ENSP00000488750

SEQ ID NO: 64207 - protein, 999 aa, Homo sapiens
  Payload ID: 12808
  Gene Symbol: PLEKHM2
  Gene Name: pleckstrin homology domain containing, family M (with RUN domain) member 2
  ENSP ID: ENSP00000364950
MEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKMIRMSTGHMEGNLQLLYVLLTDCYVYLLRKGATEKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASRDPWC

SEQ ID NO: 64208 - protein, 1019 aa, Homo sapiens
  Payload ID: 12808
  Gene Symbol: PLEKHM2
  Gene Name: pleckstrin homology domain containing, family M (with RUN domain) member 2
  Uniprot ID: Q8IWE5
  ENSP ID: ENSP00000364956
MEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKMIRMSTGHMEGNLQLLYVLLTDCYVYLLRKGATEKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASRDPWC

SEQ ID NO: 64209 - protein, 469 aa, Homo sapiens
  Payload ID: 12809
  Gene Symbol: PLEKHM3
  Gene Name: pleckstrin homology domain containing, family M, member 3
  ENSP ID: ENSP00000395354
  MOD_RES (1)..(1): Any amino acid
XNQNLYATYQLSHFQSISVLGNLEARMVDTVLYDNTQLQLKAESPWEALDWGQKLWEVVHAAVPGYMGRQNELTISPGLGHHDDYTQNHSFQKKTSGLLPPSPVLDSSKQYQNILKSGTLYRLTVQNNWKAFTFVLSRAYLMAFQPGKLDEDPLLSYNVDVCLAVQMDNLDGCDSCFQVIFPQDVLRLRAETRQRAQEWMEALKIAANVARSSEQNLQVTLRNKPKDQMGGHELRKNKRQSVTTSFLSILTTLSLERGLTAQSFKCAGCQRSIGLSNGKAKVCNYSGWYYCSSCHVDDSFLIPARIVHNWDTSKYKVSKQAKEFLEYVYEEPLIDIQQENAMLYHHAEPLAAVLRLRQRLKSLRAYLFSCRAAVAEDLRRRIFPREYLLQQIHLYSLADLQQVIEGKLAPFLGKVIKFATSHVYSCSLCSQKGFICEICNNGEILYPFEDISTSRFGDPYADLLQGYVA

SEQ ID NO: 64210 - protein, 672 aa, Homo sapiens
  Payload ID: 12809
  Gene Symbol: PLEKHM3
  Gene Name: pleckstrin homology domain containing, family M, member 3
  ENSP ID: ENSP00000400150
MEALEVDDISPALEVTEEFFSTLDSNLEKAVQQAEVYGIQEVPELVGHEVLSNITDNGAMRNVTSLGKGGMIWDHCKSRLLETKAQNVFPAKEQFMVQRGTTPDNLSWMEQKEASTFNFFNICQRRRDRPRSVNDLLDETSTFKPGHARSRSDITQVDWRVVLKTTPLQQQQQQQPLLQGPHVTRPSFLLPSPNKIEDAQGNTEHKQTFPNILKKGYLEIRKDHDSYWQSCYAELSPYNLYFYSLDSSGNQNLYATYQLSHFQSISVLGNLEARMVDTVLYDNTQLQLKAESPWEALDWGQKLWEVVHAAVPGYMGRQNELTISPGLGHHDDYTQNHSFQKKTSGLLPPSPVLDSSKQYQNILKSGTLYRLTVQNNWKAFTFVLSRAYLMAFQPGKLDEDPLLSYNVDVCLAVQMDNLDGCDSCFQVIFPQDVLRLRAETRQRAQEWMEALKIAANVARSSEQNLQVTLRNKPKDQMGGHELRKNKRQSVTTSFLSILTTLSLERGLTAQSFKCAGCQRSIGLSNGKAKVCNYSGWYYCSSCHVDDSFLIPARIVHNWDTSKYKVSKQAKEFLEYVYEEPLIDIQQENAMLYHHAEPLAAVLRLRQRLKSLRAYLFSCRAAVAEDLRRRNDQQHALVMLNVFGEFSPENTSFNRSTCIHLPTCSRPRHYSQI

SEQ ID NO: 64211 - protein, 761 aa, Homo sapiens
  Payload ID: 12809
  Gene Symbol: PLEKHM3
  Gene Name: pleckstrin homology domain containing, family M, member 3
  Uniprot ID: Q6ZWE6
  ENSP ID: ENSP00000417003
MEALEVDDISPALEVTEEFFSTLDSNLEKAVQQAEVYGIQEVPELVGHEVLSNITDNGAMRNVTSLGKGGMIWDHCKSRLLETKAQNVFPAKEQFMVQRGTTPDNLSWMEQKEASTFNFFNICQRRRDRPRSVNDLLDETSTFKPGHARSRSDITQVDWRVVLKTTPLQQQQQQQPLLQGPHVTRPSFLLPSPNKIEDAQGNTEHKQTFPNILKKGYLEIRKDHDSYWQSCYAELSPYNLYFYSLDSSGNQNLYATYQLSHFQSISVLGNLEARMVDTVLYDNTQLQLKAESPWEALDWGQKLWEVVHAAVPGYMGRQNELTISPGLGHHDDYTQNHSFQKKTSGLLPPSPVLDSSKQYQNILKSGTLYRLTVQNNWKAFTFVLSRAYLMAFQPGKLDEDPLLSYNVDVCLAVQMDNLDGCDSCFQVIFPQDVLRLRAETRQRAQEWMEALKIAANVARSSEQNLQVTLRNKPKDQMGGHELRKNKRQSVTTSFLSILTTLSLERGLTAQSFKCAGCQRSIGLSNGKAKVCNYSGWYYCSSCHVDDSFLIPARIVHNWDTSKYKVSKQAKEFLEYVYEEPLIDIQQENAMLYHHAEPLAAVLRLRQRLKSLRAYLFSCRAAVAEDLRRRIFPREYLLQQIHLYSLADLQQVIEGKLAPFLGKVIKFATSHVYSCSLCSQKGFICEICNNGEILYPFEDISTSRCESCGAVFHSECKEKSVPCPRCVRRELQKKQKSFWQRLNMDESLEEACTMFELSYQNT

SEQ ID NO: 64212 - protein, 576 aa, Homo sapiens
  Payload ID: 12810
  Gene Symbol: PLEKHN1
  Gene Name: pleckstrin homology domain containing, family N member 1
  Uniprot ID: Q494U1
  ENSP ID: ENSP00000368717
MGNSHCVPQAPRRLRASFSRKPSLKGNREDSARMSAGLPGPEAARSGDAAANKLFHYIPGTDILDLENQRENLEQPFLSVFKKGRRRVPVRNLGKVVHYAKVQLRFQHSQDVSDCYLELFPAHLYFQAHGSEGLTFQGLLPLTELSVCPLEGSREHAFQITGPLPAPLLVLCPSRAELDRWLYHLEKQTALLGGPRRCHSAPPQGSCGDELPWTLQRRLTRLRTASGHEPGGSAVCASRVKLQHLPAQEQWDRLLVLYPTSLAIFSEELDGLCFKGELPLRAVHINLEEKEKQIRSFLIEGPLINTIRVVCASYEDYGHWLLCLRAVTHREGAPPLPGAESFPGSQVMGSGRGSLSSGGQTSWDSGCLAPPSTRTSHSLPESSVPSTVGCSSQHTPLHRLSLESSPDAPDHTSETSHSPLYADPYTPPATSHRRVTDVRGLEEFLSAMQSARGPTPSSPLPSVPVSVPASDPRSCSSGPAGPYLLSKKGALQSRAAQRHRGSAKDGGPQPPDAPQLVSSAREGSPEPWLPLTDGRSPRRSRDPGYDHLWDETLSSSHQKCPQLGGPEASGGLVQWI

SEQ ID NO: 64213 - protein, 663 aa, Homo sapiens
  Payload ID: 12810
  Gene Symbol: PLEKHN1
  Gene Name: pleckstrin homology domain containing, family N member 1
  Uniprot ID: Q494U1
  ENSP ID: ENSP00000368719
MGNSHCVPQAPRRLRASFSRKPSLKGNREDSARMSAGLPGPEAARSGDAAANKLFHYIPGTDILDLENQRENLEQPFLSVFKKGRRRVPVRNLGKVVHYAKVQLRFQHSQDVSDCYLELFPAHLYFQAHGSEGLTFQGLLPLTELSVCPLEGSREHAFQITGVWDASRAPRGTPDPGLGEGPALWLRSTCVYVCALSALPAGPLPAPLLVLCPSRAELDRWLYHLEKQTALLGGPRRCHSAPPQGSCGDELPWTLQRRLTRLRTASGHEPGGSAVCASRVKLQHLPAQEQWDRLLVLYPTSLAIFSEELDGLCFKGELPLRAVHINLEEKEKQIRSFLIEGPLINTIRVVCASYEDYGHWLLCLRAVTHREGAPPLPGAESFPGSQVMGSGRGSLSSGGQTSWDSGCLAPPSTRTSHSLPESSVPSTVGCSSQHTPDQANSDRASIGRRRTELRRSGSSRSPGSKARAEGRGPVTPLHLDLTQLHRLSLESSPDAPDHTSETSHSPLYADPYTPPATSHRRVTDVRGLEEFLSAMQSARGPTPSSPLPSVPVSVPASDPRSCSSGPAGPYLLSKKGALQSRAAQRHRGSAKDGGPQPPDAPQLVSSAREGSPEPWLPLTDGRSPRRSRDPGYDHLWDETLSSSHQKCPQLGGPEASGGLVQWI

SEQ ID NO: 64214 - protein, 611 aa, Homo sapiens
  Payload ID: 12810
  Gene Symbol: PLEKHN1
  Gene Name: pleckstrin homology domain containing, family N member 1
  Uniprot ID: Q494U1
  ENSP ID: ENSP00000368720
MGNSHCVPQAPRRLRASFSRKPSLKGNREDSARMSAGLPGPEAARSGDAAANKLFHYIPGTDILDLENQRENLEQPFLSVFKKGRRRVPVRNLGKVVHYAKVQLRFQHSQDVSDCYLELFPAHLYFQAHGSEGLTFQGLLPLTELSVCPLEGSREHAFQITGPLPAPLLVLCPSRAELDRWLYHLEKQTALLGGPRRCHSAPPQRRLTRLRTASGHEPGGSAVCASRVKLQHLPAQEQWDRLLVLYPTSLAIFSEELDGLCFKGELPLRAVHINLEEKEKQIRSFLIEGPLINTIRVVCASYEDYGHWLLCLRAVTHREGAPPLPGAESFPGSQVMGSGRGSLSSGGQTSWDSGCLAPPSTRTSHSLPESSVPSTVGCSSQHTPDQANSDRASIGRRRTELRRSGSSRSPGSKARAEGRGPVTPLHLDLTQLHRLSLESSPDAPDHTSETSHSPLYADPYTPPATSHRRVTDVRGLEEFLSAMQSARGPTPSSPLPSVPVSVPASDPRSCSSGPAGPYLLSKKGALQSRAAQRHRGSAKDGGPQPPDAPQLVSSAREGSPEPWLPLTDGRSPRRSRDPGYDHLWDETLSSSHQKCPQLGGPEASGGLVQWI

SEQ ID NO: 64215 - protein, 176 aa, Homo sapiens
  Payload ID: 12810
  Gene Symbol: PLEKHN1
  Gene Name: pleckstrin homology domain containing, family N member 1
  ENSP ID: ENSP00000462558
SLESSPDAPDHTSETSHSPLYADPYTPPATSHRRVTDVRGLEEFLSAMQSARGPTPSSPLPSVPVSVPASDPRSCSSGPAGPYLLSKKGALQSRAAQRHRGSAKDGGPQPPDAPQLVSSAREGSPEPWLPLTDGRSPRRSRDPGYDHLWDETLSSSHQKCPQLGGPEASGGLVQWI

SEQ ID NO: 64216 - protein, 409 aa, Homo sapiens
  Payload ID: 12811
  Gene Symbol: PLEKHO1
  Gene Name: pleckstrin homology domain containing, family O member 1
  Uniprot ID: Q53GL0
  ENSP ID: ENSP00000358120
MMKKNNSAKRGPQDGNQQPAPPEKVGWVRKFCGKGIFREIWKNRYVVLKGDQLYISEKEVKDEKNIQEVFDLSDYEKCEELRKSKSRSKKNHSKFTLAHSKQPGNTAPNLIFLAVSPEEKESWINALNSAITRAKNRILDEVTVEEDSYLAHPTRDRAKIQHSRRPPTRGHLMAVASTSTSDGMLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 64217 - protein, 226 aa, Homo sapiens
  Payload ID: 12811
  Gene Symbol: PLEKHO1
  Gene Name: pleckstrin homology domain containing, family O member 1
  ENSP ID: ENSP00000358122
MLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 64218 - protein, 490 aa, Homo sapiens
  Payload ID: 12812
  Gene Symbol: PLEKHO2
  Gene Name: pleckstrin homology domain containing, family O member 2
  Uniprot ID: Q8TD55
  ENSP ID: ENSP00000326706
MEEEGVKEAGEKPRGAQMVDKAGWIKKSSGGLLGFWKDRYLLLCQAQLLVYENEDDQKCVETVELGSYEKCQDLRALLKRKHRFILLRSPGNKVSDIKFQAPTGEEKESWIKALNEGINRGKNKAFDEVKVDKSCALEHVTRDRVRGGQRRRPPTRVHLKEVASAASDGLLRLDLDVPDSGPPVFAPSNHVSEAQPRETPRPLMPPTKPFLAPETTSPGDRVETPVGERAPTPVSASSEVSPESQEDSETPAEEDSGSEQPPNSVLPDKLKVSWENPSPQEAPAAESAEPSQAPCSETSEAAPREGGKPPTPPPKILSEKLKASMGEMQASGPPAPGTVQVSVNGMDDSPEPAKPSQAEGTPGTPPKDATTSTALPPWDLPPQFHPRCSSLGDLLGEGPRHPLQPRERLYRAQLEVKVASEQTEKLLNKVLGSEPAPVSAETLLSQAVEQLRQATQVLQEMRDLGELSQEAPGLREKRKELVTLYRRSAP

SEQ ID NO: 64219 - protein, 440 aa, Homo sapiens
  Payload ID: 12812
  Gene Symbol: PLEKHO2
  Gene Name: pleckstrin homology domain containing, family O member 2
  Uniprot ID: Q8TD55
  ENSP ID: ENSP00000483505
MEEEDDQKCVETVELGSYEKCQDLRALLKRKHRFILLRSPGNKVSDIKFQAPTGEEKESWIKALNEGINRGKNKAFDEVKVDKSCALEHVTRDRVRGGQRRRPPTRVHLKEVASAASDGLLRLDLDVPDSGPPVFAPSNHVSEAQPRETPRPLMPPTKPFLAPETTSPGDRVETPVGERAPTPVSASSEVSPESQEDSETPAEEDSGSEQPPNSVLPDKLKVSWENPSPQEAPAAESAEPSQAPCSETSEAAPREGGKPPTPPPKILSEKLKASMGEMQASGPPAPGTVQVSVNGMDDSPEPAKPSQAEGTPGTPPKDATTSTALPPWDLPPQFHPRCSSLGDLLGEGPRHPLQPRERLYRAQLEVKVASEQTEKLLNKVLGSEPAPVSAETLLSQAVEQLRQATQVLQEMRDLGELSQEAPGLREKRKELVTLYRRSAP

SEQ ID NO: 64220 - protein, 198 aa, Homo sapiens
  Payload ID: 12813
  Gene Symbol: PLEKHS1
  Gene Name: pleckstrin homology domain containing, family S member 1
  ENSP ID: ENSP00000346451
MESYFFKETSHESVDSSKEEPQTLPETQDGDLHLQEQGSGIDWCLSPADVEAQTTNDQKGNIPDESQVEKLNVFLSPPDVINYLALTEATGRICVSQWEGPPRLGCIFCHGDHLLAVNDLKPQSLEEVSLFLTRSIQKEKLKLTIGRIPNSETFHAASCMCPSKCQSAAPSQLDKPRLNRAPKRSPAIKKSQQKGARE

SEQ ID NO: 64221 - protein, 363 aa, Homo sapiens
  Payload ID: 12813
  Gene Symbol: PLEKHS1
  Gene Name: pleckstrin homology domain containing, family S member 1
  Uniprot ID: Q5SXH7
  ENSP ID: ENSP00000354332
MEPKPQKSPGKQFTFSYENEVCKQDYFIKSPPSQLFSSVTSWKKRFFILSKAGEKSFSLSYYKDHHHRGSIEIDQNSSVEVGISSQEKMQSVQKMFKCHPDEVMSIRTTNREYFLIGHDREKIKDWVSFMSSFRQDIKATQQNTEEELSLGNKRTLFYSSPLLGPSSTSEAVGSSSPRNGLQDKHLMEQSSPGFRQTHLQDLSEATQDVKEENHYLTPRSVLLELDNIIASSDSGESIETDGPDQVSGRIECHYEPMESYFFKETSHESVDSSKEEPQTLPETQDGDLHLQEQGSGIDWCLSPADVEAQTTNDQKGSASLTVVQLSILINNIPDESQVEKLNVFLSPPDVINYLALTEATGRI

SEQ ID NO: 64222 - protein, 282 aa, Homo sapiens
  Payload ID: 12813
  Gene Symbol: PLEKHS1
  Gene Name: pleckstrin homology domain containing, family S member 1
  ENSP ID: ENSP00000358315
MEQSSPGFRQTHLQDLSEATQDVKEENHYLTPRSVLLELDNIIASSDSGESIETDGPDQVSGRIECHYEPMESYFFKETSHESVDSSKEEPQTLPETQDGDLHLQEQGSGIDWCLSPADVEAQTTNDQKGSASLTVVQLSILINNIPDESQVEKLNVFLSPPDVINYLALTEATGRICVSQWEGPPRLGCIFCHGDHLLAVNDLKPQSLEEVSLFLTRSIQKEKLKLTIGRIPNSETFHAASCMCPSKCQSAAPSQLDKPRLNRAPKRSPAIKKSQQKGARE

SEQ ID NO: 64223 - protein, 465 aa, Homo sapiens
  Payload ID: 12813
  Gene Symbol: PLEKHS1
  Gene Name: pleckstrin homology domain containing, family S member 1
  Uniprot ID: Q5SXH7
  ENSP ID: ENSP00000358316
MAGGKQFTFSYENEVCKQDYFIKSPPSQLFSSVTSWKKRFFILSKAGEKSFSLSYYKDHHHRGSIEIDQNSSVEVGISSQEKMQSVQKMFKCHPDEVMSIRTTNREYFLIGHDREKIKDWVSFMSSFRQDIKATQQNTEEELSLGNKRTLFYSSPLLGPSSTSEAVGSSSPRNGLQDKHLMEQSSPGFRQTHLQDLSEATQDVKEENHYLTPRSVLLELDNIIASSDSGESIETDGPDQVSGRIECHYEPMESYFFKETSHESVDSSKEEPQTLPETQDGDLHLQEQGSGIDWCLSPADVEAQTTNDQKGNIPDESQVEKLNVFLSPPDVINYLALTEATGRICVSQWEGPPRLGCIFCHGDHLLAVNDLKPQSLEEVSLFLTRSIQKEDSFRILSYQVAFGEGTELRDRAPGFRTSDRHDVAKRACMESDWCRDSKTAPSTNLCLSFLFCKIMTNDGAGCWIIK

SEQ ID NO: 64224 - protein, 366 aa, Homo sapiens
  Payload ID: 12813
  Gene Symbol: PLEKHS1
  Gene Name: pleckstrin homology domain containing, family S member 1
  Uniprot ID: Q5SXH7
  ENSP ID: ENSP00000358318
MQSVQKMFKCHPDEVMSIRTTNREYFLIGHDREKIKDWVSFMSSFRQDIKATQQNTEEELSLGNKRTLFYSSPLLGPSSTSEAVGSSSPRNGLQDKHLMEQSSPGFRQTHLQDLSEATQDVKEENHYLTPRSVLLELDNIIASSDSGESIETDGPDQVSGRIECHYEPMESYFFKETSHESVDSSKEEPQTLPETQDGDLHLQEQGSGIDWCLSPADVEAQTTNDQKGNIPDESQVEKLNVFLSPPDVINYLALTEATGRICVSQWEGPPRLGCIFCHGDHLLAVNDLKPQSLEEVSLFLTRSIQKEKLKLTIGRIPNSETFHAASCMCPSKCQSAAPSQLDKPRLNRAPKRSPAIKKSQQKGARE

SEQ ID NO: 64225 - protein, 196 aa, Homo sapiens
  Payload ID: 12813
  Gene Symbol: PLEKHS1
  Gene Name: pleckstrin homology domain containing, family S member 1
  ENSP ID: ENSP00000390757
  MOD_RES (1)..(1): Any amino acid
XQEQGSGIDWCLSPADVEAQTTNDQKGSASLTVVQLSILINNIPDESQVEKLNVFLSPPDVINYLALTEATGRICVSQWEGPPRLGCIFCHGDHLLAVNDLKPQSLEEVSLFLTRSIQKEDSFRILSYQVAFGEGTELRDRAPGFRTSDRHDVAKRACMESDWCRDSKTAPSTNLCLSFLFCKIMTNDGAGCWIIK

SEQ ID NO: 64226 - protein, 366 aa, Homo sapiens; identical to SEQ ID NO: 64224
  Payload ID: 12813
  Gene Symbol: PLEKHS1
  Gene Name: pleckstrin homology domain containing, family S member 1
  Uniprot ID: Q5SXH7
  ENSP ID: ENSP00000483759

SEQ ID NO: 64227 - protein, 1821 aa, Homo sapiens
  Payload ID: 12814
  Gene Symbol: PHIP
  Gene Name: pleckstrin homology domain interacting protein
  Uniprot ID: Q8WWQ0
  ENSP ID: ENSP00000275034
MSCERKGLSELRSELYFLIARFLEDGPCQQAAQVLIREVAEKELLPRRTDWTGKEHPRTYQNLVKYYRHLAPDHLLQICHRLGPLLEQEIPQSVPGVQTLLGAGRQSLLRTNKSCKHVVWKGSALAALHCGRPPESPVNYGSPPSIADTLFSRKLNGKYRLERLVPTAVYQHMKMHKRILGHLSSVYCVTFDRTGRRIFTGSDDCLVKIWATDDGRLLATLRGHAAEISDMAVNYENTMIAAGSCDKMIRVWCLRTCAPLAVLQGHSASITSLQFSPLCSGSKRYLSSTGADGTICFWLWDAGTLKINPRPAKFTERPRPGVQMICSSFSAGGMFLATGSTDHIIRVYFFGSGQPEKISELEFHTDKVDSIQFSNTSNRFVSGSRDGTARIWQFKRREWKSILLDMATRPAGQNLQGIEDKITKMKVTMVAWDRHDNTVITAVNNMTLKVWNSYTGQLIHVLMGHEDEVFVLEPHPFDPRVLFSAGHDGNVIVWDLARGVKIRSYFNMIEGQGHGAVFDCKCSPDGQHFACTDSHGHLLIFGFGSSSKYDKIADQMFFHSDYRPLIRDANNFVLDEQTQQAPHLMPPPFLVDVDGNPHPSRYQRLVPGRENCREEQLIPQMGVTSSGLNQVLSQQANQEISPLDSMIQRLQQEQDLRRSGEAVISNTSRLSRGSISSTSEVHSPPNVGLRRSGQIEGVRQMHSNAPRSEIATERDLVAWSRRVVVPELSAGVASRQEEWRTAKGEEEIKTYRSEEKRKHLTVPKENKIPTVSKNHAHEHFLDLGESKKQQTNQHNYRTRSALEETPRPSEEIENGSSSSDEGEVVAVSGGTSEEEERAWHSDGSSSDYSSDYSDWTADAGINLQPPKKVPKNKTKKAESSSDEEEESEKQKQKQIKKEKKKVNEEKDGPISPKKKKPKERKQKRLAVGELTENGLTLEEWLPSTWITDTIPRRCPFVPQMGDEVYYFRQGHEAYVEMARKNKIYSINPKKQPWHKMELREQELMKIVGIKYEVGLPTLCCLKLAFLDPDTGKLTGGSFTMKYHDMPDVIDFLVLRQQFDDAKYRRWNIGDRFRSVIDDAWWFGTIESQEPLQLEYPDSLFQCYNVCWDNGDTEKMSPWDMELIPNNAVFPEELGTSVPLTDGECRSLIYKPLDGEWGTNPRDEECERIVAGINQLMTLDIASAFVAPVDLQAYPMYCTVVAYPTDLSTIKQRLENRFYRRVSSLMWEVRYIEHNTRTFNEPGSPIVKSAKFVTDLLLHFIKDQTCYNIIPLYNSMKKKVLSDSEDEEKDADVPGTSTRKRKDHQPRRRLRNRAQSYDIQAWKKQCEELLNLIFQCEDSEPFRQPVDLLEYPDYRDIIDTPMDFATVRETLEAGNYESPMELCKDVRLIFSNSKAYTPSKRSRIYSMSLRLSAFFEEHISSVLSDYKSALRFHKRNTITKRRKKRNRSSSVSSSAASSPERKKRILKPQLKSESSTSAFSTPTRSIPPRHNAAQINGKTESSSVVRTRSNRVVVDPVVTEQPSTSSAAKTFITKANASAIPGKTILENSVKHSKALNTLSSPGQSSFSHGTRNNSAKENMEKEKPVKRKMKSSVLPKASTLSKSSAVIEQGDCKNNALVPGTIQVNGHGGQPSKLVKRGPGRKPKVEVNTNSGEIIHKKRGRKPKKLQYAKPEDLEQNNVHPIRDEVLPSSTCNFLSETNNVKEDLLQKKNRGGRKPKRKMKTQKLDADLLVPASVKVLRRSNRKKIDDPIDEEEEFEELKGSEPHMRTRNQGRRTAFYNEDDSEEEQRQLLFEDTSLTFGTSSRGRVRKLTEKAKANLIGW

SEQ ID NO: 64228 - protein, 401 aa, Homo sapiens
  Payload ID: 12815
  Gene Symbol: PHLDA1
  Gene Name: pleckstrin homology-like domain, family A, member 1
  Uniprot ID: Q8WV24
  ENSP ID: ENSP00000266671
MRRAPAAERLLELGFPPRCGRQEPPFPLGVTRGWGRWPIQKRREGARPVPFSERSQEDGRGPAARSSGTLWRIRTRLSLCRDPEPPPPLCLLRVSLLCALRAGGRGSRWGEDGARLLLLPPARAAGNGEAEPSGGPSYAGRMLESSGCKALKEGVLEKRSDGLLQLWKKKCCILTEEGLLLIPPKQLQHQQQQQQQQQQQQQQQPGQGPAEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQPPSQPQPQPQLQPQPQPQPQPQPQPQSQPQPQPQPKPQPQQLHPYPHPHPHPHSHPHSHPHPHPHPHPHQIPHPHPQPHSQPHGHRLLRSTSNSA

SEQ ID NO: 64229 - protein, 260 aa, Homo sapiens
  Payload ID: 12815
  Gene Symbol: PHLDA1
  Gene Name: pleckstrin homology-like domain, family A, member 1
  ENSP ID: ENSP00000473593
MLESSGCKALKEGVLEKRSDGLLQLWKKKCCILTEEGLLLIPPKQLQHQQQQQQQQQQQQQQQPGQGPAEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQPPSQPQPQPQLQPQPQPQPQPQPQPQSQPQPQPQPKPQPQQLHPYPHPHPHPHSHPHSHPHPHPHPHPHQIPHPHPQPHSQPHGHRLLRSTSNSA

SEQ ID NO: 64230 - protein, 401 aa, Homo sapiens; identical to SEQ ID NO: 64228
  Payload ID: 12815
  Gene Symbol: PHLDA1
  Gene Name: pleckstrin homology-like domain, family A, member 1
  Uniprot ID: Q8WV24
  ENSP ID: ENSP00000480767

SEQ ID NO: 64231 - protein, 152 aa, Homo sapiens
  Payload ID: 12816
  Gene Symbol: PHLDA2
  Gene Name: pleckstrin homology-like domain, family A, member 2
  Uniprot ID: Q53GA4
  ENSP ID: ENSP00000319231
MKSPDEVLREGELEKRSDSLFQLWKKKRGVLTSDRLSLFPASPRARPKELRFHSILKVDCVERTGKYVYFTIVTTDHKEIDFRCAGESCWNAAIALALIDFQNRRALQDFRSRQERTAPAAPAEDAVAAAAAAPSEPSEPSRPSPQPKPRTP

SEQ ID NO: 64232 - protein, 152 aa, Homo sapiens; identical to SEQ ID NO: 64231
  Payload ID: 12816
  Gene Symbol: PHLDA2
  Gene Name: pleckstrin homology-like domain, family A, member 2
  Uniprot ID: Q53GA4
  ENSP ID: ENSP00000483602

SEQ ID NO: 64233 - protein, 127 aa, Homo sapiens
  Payload ID: 12817
  Gene Symbol: PHLDA3
  Gene Name: pleckstrin homology-like domain, family A, member 3
  Uniprot ID: Q9Y5J5
  ENSP ID: ENSP00000356278
MTAAATATVLKEGVLEKRSGGLLQLWKRKRCVLTERGLQLFEAKGTGGRPKELSFARIKAVECVESTGRHIYFTLVTEGGGEIDFRCPLEDPGWNAQITLGLVKFKNQQAIQTVRARQSLGTGTLVS

SEQ ID NO: 64234 - protein, 127 aa, Homo sapiens; identical to SEQ ID NO: 64233
  Payload ID: 12817
  Gene Symbol: PHLDA3
  Gene Name: pleckstrin homology-like domain, family A, member 3
  Uniprot ID: Q9Y5J5
  ENSP ID: ENSP00000356280

SEQ ID NO: 64235 - protein, 1319 aa, Homo sapiens
  Payload ID: 12818
  Gene Symbol: PHLDB1
  Gene Name: pleckstrin homology-like domain, family B, member 1
  Uniprot ID: Q86UU1
  ENSP ID: ENSP00000348359
MDALNRNQIGPGCQTQTMVQKGPLDLIETGKGLKVQTDKPHLVSLGSGRLSTAITLLPLEEGRTVIGSAARDISLQGPGLAPEHCYIENLRGTLTLYPCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 64236 - protein, 1377 aa, Homo sapiens
  Payload ID: 12818
  Gene Symbol: PHLDB1
  Gene Name: pleckstrin homology-like domain, family B, member 1
  Uniprot ID: Q86UU1
  ENSP ID: ENSP00000354498
MDALNRNQIGPGCQTQTMVQKGPLDLIETGKGLKVQTDKPHLVSLGSGRLSTAITLLPLEEGRTVIGSAARDISLQGPGLAPEHCYIENLRGTLTLYPCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEMEKLLLPAVDLEQWYQELMAGLGTGPAAASPHSSPPPLPAKASRQLQVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKKRFFRFTMVTESPNPALTFCVKTHDRLYYMVAPSAEAMRIWMDVIVTGAEGYTQFMN

SEQ ID NO: 64237 - protein, 995 aa, Homo sapiens
  Payload ID: 12818
  Gene Symbol: PHLDB1
  Gene Name: pleckstrin homology-like domain, family B, member 1
  Uniprot ID: Q86UU1
  ENSP ID: ENSP00000431508
MDALNRNQIGPGCQTQTMVQKGPLDLIETGKGLKVQTDKPHLVSLGSGRLSTAITLLPLEEGRTVIGSAARDISLQGPGLAPEHCYIENLRGTLTLYPCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEVYRSKMDGEATSPLPRTRSGPLPSSSGSSSSSSQLSVATLGRSPSPKSALLTQNGTGSLPRNLAATLQDIETKRQLALQQKGE

SEQ ID NO: 64238 - protein, 995 aa, Homo sapiens; identical to SEQ ID NO: 64237
  Payload ID: 12818
  Gene Symbol: PHLDB1
  Gene Name: pleckstrin homology-like domain, family B, member 1
  Uniprot ID: Q86UU1
  ENSP ID: ENSP00000435520

SEQ ID NO: 64239 - protein, 1377 aa, Homo sapiens; identical to SEQ ID NO: 64236
  Payload ID: 12818
  Gene Symbol: PHLDB1
  Gene Name: pleckstrin homology-like domain, family B, member 1
  Uniprot ID: Q86UU1
  ENSP ID: ENSP00000469820

SEQ ID NO: 64240 - protein, 101 aa, Homo sapiens
  Payload ID: 12818
  Gene Symbol: PHLDB1
  Gene Name: pleckstrin homology-like domain, family B, member 1
  ENSP ID: ENSP00000470046
MGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 64241 - protein, 209 aa, Homo sapiens
  Payload ID: 12818
  Gene Symbol: PHLDB1
  Gene Name: pleckstrin homology-like domain, family B, member 1
  ENSP ID: ENSP00000478254
MDALNRNQIGPGCQTQTMVQKGPLDLIETGKGLKVQTDKPHLVSLGSGRLSTAITLLPLEEGRTVIGSAARDISLQGPGLAPEHCYIENLRGTLTLYPCGNACTIDGLPVRQPTRLTQVETGLHHIGQAGLQLPTSGCMLCLGQSTFLRFNHPAEAKWMKSMIPAGGRAPGPPYSPVPAESESLVNGNHTPQTATRGPSACASHSSLVS

SEQ ID NO: 64242 - protein, 247 aa, Homo sapiens
  Payload ID: 12818
  Gene Symbol: PHLDB1
  Gene Name: pleckstrin homology-like domain, family B, member 1
  ENSP ID: ENSP00000481393
MDALNRNQIGPGCQTQTMVQKGPLDLIETGKGLKVQTDKPHLVSLGSGRLSTAITLLPLEEGRTVIGSAARDISLQGPGLAPEHCYIENLRGTLTLYPCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGHVCGLQL

SEQ ID NO: 64243 - protein, 641 aa, Homo sapiens
  Payload ID: 12818
  Gene Symbol: PHLDB1
  Gene Name: pleckstrin homology-like domain, family B, member 1
  ENSP ID: ENSP00000482728
QVLGHVEQLKVRVKELEQQLQESAREAEMERALLQGEREAERALLQKEQKAVDQLQEKLVALETGIQKERDKERAELAAGRRHLEARQALYAELQTQLDNCPESVREQLQEQLRREAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 64244 - protein, 1237 aa, Homo sapiens
  Payload ID: 12819
  Gene Symbol: PHLDB2
  Gene Name: pleckstrin homology-like domain, family B, member 2
  Uniprot ID: Q86SQ0
  ENSP ID: ENSP00000377500
MEEEDTKREVPKEDGVGDVQHFDSSKIMEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSKEHFRSLEERKKQHKEGLYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 64245 - protein, 1253 aa, Homo sapiens
  Payload ID: 12819
  Gene Symbol: PHLDB2
  Gene Name: pleckstrin homology-like domain, family B, member 2
  Uniprot ID: Q86SQ0
  ENSP ID: ENSP00000377502
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKEKVKLDAEREKLERLQELYSEQKTQLDNCPESMREQLQQQLKRDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSKEHFRSLEERKKQHKEGLYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 64246 - protein, 1210 aa, Homo sapiens
  Payload ID: 12819
  Gene Symbol: PHLDB2
  Gene Name: pleckstrin homology-like domain, family B, member 2
  Uniprot ID: Q86SQ0
  ENSP ID: ENSP00000405292
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSKEHFRSLEERKKQHKEGLYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 64247 - protein, 1253 aa, Homo sapiens; identical to SEQ ID NO: 64245
  Payload ID: 12819
  Gene Symbol: PHLDB2
  Gene Name: pleckstrin homology-like domain, family B, member 2
  Uniprot ID: Q86SQ0
  ENSP ID: ENSP00000405405

SEQ ID NO: 64248 - protein, 519 aa, Homo sapiens
  Payload ID: 12819
  Gene Symbol: PHLDB2
  Gene Name: pleckstrin homology-like domain, family B, member 2
  ENSP ID: ENSP00000417497
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLVIFISTVIDLTVSLTSIYRAALEMDSRICGNIGYSCSLATAAIFLFSPAILLLPISLLIGLFGYLEGLQELMLI

SEQ ID NO: 64249 - protein, 581 aa, Homo sapiens
  Payload ID: 12819
  Gene Symbol: PHLDB2
  Gene Name: pleckstrin homology-like domain, family B, member 2
  ENSP ID: ENSP00000418198
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKVMLAQQRY

SEQ ID NO: 64250 - protein, 1115 aa, Homo sapiens
  Payload ID: 12819
  Gene Symbol: PHLDB2
  Gene Name: pleckstrin homology-like domain, family B, member 2
  ENSP ID: ENSP00000418296
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSKEHFRSLEERKKQHKEGLYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIK

SEQ ID NO: 64251 - protein, 1210 aa, Homo sapiens; identical to SEQ ID NO: 64246
  Payload ID: 12819
  Gene Symbol: PHLDB2
  Gene Name: pleckstrin homology-like domain, family B, member 2
  Uniprot ID: Q86SQ0
  ENSP ID: ENSP00000418319

SEQ ID NO: 64252 - protein, 744 aa, Homo sapiens
  Payload ID: 12819
  Gene Symbol: PHLDB2
  Gene Name: pleckstrin homology-like domain, family B, member 2
  ENSP ID: ENSP00000420303
MRVCSYECLPWEEAMRTELQLESRSSGSEREERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKEKVKLDAEREKLERLQELYSEQKTQLDNCPESMREQLQQQLKRDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 64253 - protein, 640 aa, Homo sapiens
  Payload ID: 12820
  Gene Symbol: PHLDB3
  Gene Name: pleckstrin homology-like domain, family B, member 3
  Uniprot ID: Q6NSJ2
  ENSP ID: ENSP00000292140
MGTRSSPEEGTPPPLVPECDVEVQPQGHPEESREQEASEVLAEPSSRGGAEQQAEEEEVGEGSSTESSRDAPEATPPIAMAATPPASTSSREGVRGAARRLQGQQLEALTRVALMEQRVKELQRQRKELRIEMEVEVALLRGELAGERVAARREEEQLRELLEQQAASEQRGRQQREQEQRRLSQERDRLEGLRQRLRKAQGQLDSQPEDQRERLLQGVQEMREQLDVAQRAYEDLEFQQLERESRQEEEDRDSPGPQVPDPKVQELQASMAQHRRGALQHRIRVLEEQLKSLGEQMAAESRGLSRKKEEALQALSQERSRLLELNCLQGTPGGDFSEPNPALTKLLFTQKTDRQLLVLQDAVAHSAATPTSSCLFSVHSSLQGSIGLQRTGSLPRKRGERGSQRGSPRPLSFHCTESLEASALPPAVGDSGRYPLYQLLNCGRGNSCGAIHPDIAHMERLLQQAMAERERLLKAREGTRRGTEGSSGPAVPAITAPPTPPHPPGPRILDLRQHLEGWGHNPENCPHVQVSGCCCRGPLVKMGGRIKTWRKRWFCFDRQARRLAYYADKEETKLKGVIYFQAIEEVYYDHLRCAFKSPNPRLTFCVKTYERLFYMVAPSPEAMRIWMDVIVTAADENHAP

SEQ ID NO: 64254 - protein, 122 aa, Homo sapiens
  Payload ID: 12820
  Gene Symbol: PHLDB3
  Gene Name: pleckstrin homology-like domain, family B, member 3
  ENSP ID: ENSP00000469372
CHPYFFLPLFCPQLPAESLEASALPPAVGDSGRYPLYQLLNCGRGNSCGAIHPDIAHMERLLQQAMAERERLLKAREGTRRGTEGSSGPAVPAITAPPTPPHPPGPRILDLRQHLEGWGHNP

SEQ ID NO: 64255 - protein, 101 aa, Homo sapiens
  Payload ID: 12820
  Gene Symbol: PHLDB3
  Gene Name: pleckstrin homology-like domain, family B, member 3
  ENSP ID: ENSP00000470976
MGTRSSPEEGTPPPLVPECDVEVQPQGHPEESREQEASEVLAEPSSRGGAEQQAEEEEVGEGSSTESSRDAPEATPPIAMAATPPASTSSREGVRGAARRL

SEQ ID NO: 64256 - protein, 279 aa, Homo sapiens
  Payload ID: 12820
  Gene Symbol: PHLDB3
  Gene Name: pleckstrin homology-like domain, family B, member 3
  Uniprot ID: Q6NSJ2
  ENSP ID: ENSP00000471158
MGTRSSPEEGTPPPLVPECDVEVQPQGHPEESREQEASEVLAEPSSRGGAEQQAEEEEVGEGSSTESSRDAPEATPPIAMAATPPASTSSREGVRGAARRLQGQQLEALTRVALMEQRVKELQRQRKELRIEMEVEVALLRGELAGERVAARREEEQLRELLEQQAASEQRGRQQREQEQRRLSQERDRLEGLRQRLRKAQGQLDSQPEDQRERLLQGVQEMREQLDVAQRAYEDLEFQQLERESRQEEEDRDSPGPQVPDPKVQELQASMAQHRVSHA

SEQ ID NO: 64257 - protein, 232 aa, Homo sapiens
  Payload ID: 12820
  Gene Symbol: PHLDB3
  Gene Name: pleckstrin homology-like domain, family B, member 3
  ENSP ID: ENSP00000473000
QRLRKAQGQLDSQPEDQRERLLQGVQEMREQLDVAQRAYEDLEFQQLERESRQEEEDRDSPGPQVPDPKVQELQASMAQHRHRIRVLEEQLKSLGEQMAAESRGLSRKKEEALQALSQERSRLLELNCLQGTPGGDFSEPNPALTKLLFTQKTDRQLLVLQDAVAHSAATPTSSCLFSVHSSLQAPPTPPHPPGPRILDLRQHLEGWGHNPENCPHVQVSGCCCRGPLVKMG

SEQ ID NO: 64258 - protein, 110 aa, Homo sapiens
  Payload ID: 12820
  Gene Symbol: PHLDB3
  Gene Name: pleckstrin homology-like domain, family B, member 3
  ENSP ID: ENSP00000473248
MGTRSSPEEGTPPPLVPECDVEVQPQGHPEESREQEASEVLAEPSSRGGAEQQAEEEEVGEGSSTESSRDAPEATPPIAMAATPPASTSSREGVRGAARRLQGQQLEALT

SEQ ID NO: 64259 - protein, 4684 aa, Homo sapiens
  Payload ID: 12821
  Gene Symbol: PLEC
  Gene Name: plectin
  Uniprot ID: Q15149
  ENSP ID: ENSP00000323856
MVAGMLMPRDQLRAIYEVLFREGVMVAKKDRRPRSLHPHVPGVTNLQVMRAMASLRARGLVRETFAWCHFYWYLTNEGIAHLRQYLHLPPEIVPASLQRVRRPVAMVMPARRTPHVQAVQGPLGSPPKRGPLPTEEQRVYRRKELEEVSPETPVVPATTQRTLARPGPEPAPATDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 64260 - protein, 4547 aa, Homo sapiens
  Payload ID: 12821
  Gene Symbol: PLEC
  Gene Name: plectin
  Uniprot ID: Q15149
  ENSP ID: ENSP00000344848
MSQHQLRVPQPEGLGRKRTSSEDNLYLAVLRASEGKKDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 64261 - protein, 4547 aa, Homo sapiens
  Payload ID: 12821
  Gene Symbol: PLEC
  Gene Name: plectin
  Uniprot ID: Q15149
  ENSP ID: ENSP00000346602
MEPSGSLFPSLVVVGHVVTLAAVWHWRRGRRWAQDEQDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 64262 - protein, 4525 aa, Homo sapiens
  Payload ID: 12821
  Gene Symbol: PLEC
  Gene Name: plectin
  Uniprot ID: Q15149
  ENSP ID: ENSP00000347044
MDPSRAIQNEISSLKDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 64263 - protein, 4533 aa, Homo sapiens
  Payload ID: 12821
  Gene Symbol: PLEC
  Gene Name: plectin
  Uniprot ID: Q15149
  ENSP ID: ENSP00000348702
MAGPLPDEQDFIQAYEEVREKYKDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 64264 - protein, 4551 aa, Homo sapiens
  Payload ID: 12821
  Gene Symbol: PLEC
  Gene Name: plectin
  Uniprot ID: Q15149
  ENSP ID: ENSP00000350277
MSGAGGAFASPREVLLERPCWLDGGCEPARRGYLYQQLCCVDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 64265 - protein, 4515 aa, Homo sapiens
  Payload ID: 12821
  Gene Symbol: PLEC
  Gene Name: plectin
  Uniprot ID: Q15149
  ENSP ID: ENSP00000381756
MKIVPDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 64266 - protein, 4574 aa, Homo sapiens
  Payload ID: 12821
  Gene Symbol: PLEC
  Gene Name: plectin
  Uniprot ID: Q15149
  ENSP ID: ENSP00000388180
MSGEDAEVRAVSEDVSNGSSGSPSPGDTLPWNLGKTQRSRRSGGGAGSNGSVLDPAERAVIRIADERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 64267 - protein, 190 aa, Homo sapiens
  Payload ID: 12821
  Gene Symbol: PLEC
  Gene Name: plectin
  ENSP ID: ENSP00000433557
MDRYSMEELIQLGQDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQ

SEQ ID NO: 64268 - protein, 199 aa, Homo sapiens
  Payload ID: 12821
  Gene Symbol: PLEC
  Gene Name: plectin
  ENSP ID: ENSP00000433982
  MOD_RES (1)..(1): Any amino acid
XVQSGSESVIQEYVDLRTHYSELTTLTSQYIKFISETLRRMEEEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNG

SEQ ID NO: 64269 - protein, 83 aa, Homo sapiens
  Payload ID: 12821
  Gene Symbol: PLEC
  Gene Name: plectin
  ENSP ID: ENSP00000434490
MRFHKLQNVQIALDYLRHRQVKLVNIRNDDIADGNPKLTLGLIWTIILHFQISDIQVSGQSEDMTAKEKLLLWSQRMVEGYQG

SEQ ID NO: 64270 - protein, 4570 aa, Homo sapiens
  Payload ID: 12821
  Gene Symbol: PLEC
  Gene Name: plectin
  Uniprot ID: Q15149
  ENSP ID: ENSP00000434583
MSGEDAEVRAVSEDVSNGSSGSPSPGDTLPWNLGKTQRSRRSGGGAGSNGSVLDPAERAVIRIADERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 64271 - protein, 174 aa, Homo sapiens
  Payload ID: 12821
  Gene Symbol: PLEC
  Gene Name: plectin
  ENSP ID: ENSP00000436702
MDQVRSLSTEAWRGPPCCSRAGACVRRASRGQRQGCGGTCLCSESTGCCCPVLGDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSED

SEQ ID NO: 64272 - protein, 703 aa, Homo sapiens
  Payload ID: 12821
  Gene Symbol: PLEC
  Gene Name: plectin
  ENSP ID: ENSP00000437303
MSGEDAEVRAVSEDVSNGSSGSPSPGDTLPWNLGKTQRSRRSGGGAGSNGSVLDPAERAVIRIADERDRVQKKTFTKWVNKHLIKHWRAEAQRHISDLYEDLRDGHNLISLLEVLSGDSLPRERDVSRSSRLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYS

SEQ ID NO: 64273 - protein, 500 aa, Homo sapiens
  Payload ID: 12822
  Gene Symbol: PLAG1
  Gene Name: pleiomorphic adenoma gene 1
  Uniprot ID: Q6DJT9
  ENSP ID: ENSP00000325546
MATVIPGDLSEVRDTQKVPSGKRKRGETKPRKNFPCQLCDKAFNSVEKLKVHSYSHTGERPYKCIQQDCTKAFVSKYKLQRHMATHSPEKTHKCNYCEKMFHRKDHLKNHLHTHDPNKETFKCEECGKNYNTKLGFKRHLALHAATSGDLTCKVCLQTFESTGVLLEHLKSHAGKSSGGVKEKKHQCEHCDRRFYTRKDVRRHMVVHTGRKDFLCQYCAQRFGRKDHLTRHMKKSHNQELLKVKTEPVDFLDPFTCNVSVPIKDELLPVMSLPSSELLSKPFTNTLQLNLYNTPFQSMQSSGSAHQMITTLPLGMTCPIDMDTVHPSHHLSFKYPFSSTSYAISIPEKEQPLKGEIESYLMELQGGVPSSSQDSQASSSSKLGLDPQIGSLDDGAGDLSLSKSSISISDPLNTPALDFSQLFNFIPLNGPPYNPLSVGSLGMSYSQEEAHSSVSQLPPQTQDLQDPANTIGLGSLHSLSAAFTSSLSTSTTLPRFHQAFQ

SEQ ID NO: 64274 - protein, 418 aa, Homo sapiens
  Payload ID: 12822
  Gene Symbol: PLAG1
  Gene Name: pleiomorphic adenoma gene 1
  Uniprot ID: Q6DJT9
  ENSP ID: ENSP00000404067
MATHSPEKTHKCNYCEKMFHRKDHLKNHLHTHDPNKETFKCEECGKNYNTKLGFKRHLALHAATSGDLTCKVCLQTFESTGVLLEHLKSHAGKSSGGVKEKKHQCEHCDRRFYTRKDVRRHMVVHTGRKDFLCQYCAQRFGRKDHLTRHMKKSHNQELLKVKTEPVDFLDPFTCNVSVPIKDELLPVMSLPSSELLSKPFTNTLQLNLYNTPFQSMQSSGSAHQMITTLPLGMTCPIDMDTVHPSHHLSFKYPFSSTSYAISIPEKEQPLKGEIESYLMELQGGVPSSSQDSQASSSSKLGLDPQIGSLDDGAGDLSLSKSSISISDPLNTPALDFSQLFNFIPLNGPPYNPLSVGSLGMSYSQEEAHSSVSQLPPQTQDLQDPANTIGLGSLHSLSAAFTSSLSTSTTLPRFHQAFQ

SEQ ID NO: 64275 - protein, 500 aa, Homo sapiens; identical to SEQ ID NO: 64273
  Payload ID: 12822
  Gene Symbol: PLAG1
  Gene Name: pleiomorphic adenoma gene 1
  Uniprot ID: Q6DJT9
  ENSP ID: ENSP00000416537

SEQ ID NO: 64276 - protein, 463 aa, Homo sapiens
  Payload ID: 12823
  Gene Symbol: PLAGL1
  Gene Name: pleiomorphic adenoma gene-like 1
  Uniprot ID: Q9UM63
  ENSP ID: ENSP00000346810
MATFPCQLCGKTFLTLEKFTIHNYSHSRERPYKCVQPDCGKAFVSRYKLMRHMATHSPQKSHQCAHCEKTFNRKDHLKNHLQTHDPNKMAFGCEECGKKYNTMLGYKRHLALHAASSGDLTCGVCALELGSTEVLLDHLKAHAEEKPPSGTKEKKHQCDHCERCFYTRKDVRRHLVVHTGCKDFLCQFCAQRFGRKDHLTRHTKKTHSQELMKESLQTGDLLSTFHTISPSFQLKAAALPPFPLGASAQNGLASSLPAEVHSLTLSPPEQAAQPMQPLPESLASLHPSVSPGSPPPPLPNHKYNTTSTSYSPLASLPLKADTKGFCNISLFEDLPLQEPQSPQKLNPGFDLAKGNAGKVNLPKELPADAVNLTIPASLDLSPLLGFWQLPPPATQNTFGNSTLALGPGESLPHRLSCLGQQQQEPPLAMGTVSLGQLPLPPIPHVFSAGTGSAILPHFHHAFR

SEQ ID NO: 64277 - protein, 463 aa, Homo sapiens; identical to SEQ ID NO: 64276
  Payload ID: 12823
  Gene Symbol: PLAGL1
  Gene Name: pleiomorphic adenoma gene-like 1
  Uniprot ID: Q9UM63
  ENSP ID: ENSP00000353734

SEQ ID NO: 64278 - protein, 463 aa, Homo sapiens; identical to SEQ ID NO: 64276
  Payload ID: 12823
  Gene Symbol: PLAGL1
  Gene Name: pleiomorphic adenoma gene-like 1
  Uniprot ID: Q9UM63
  ENSP ID: ENSP00000356543

SEQ ID NO: 64279 - protein, 411 aa, Homo sapiens
  Payload ID: 12823
  Gene Symbol: PLAGL1
  Gene Name: pleiomorphic adenoma gene-like 1
  Uniprot ID: Q9UM63
  ENSP ID: ENSP00000356544
MATHSPQKSHQCAHCEKTFNRKDHLKNHLQTHDPNKMAFGCEECGKKYNTMLGYKRHLALHAASSGDLTCGVCALELGSTEVLLDHLKAHAEEKPPSGTKEKKHQCDHCERCFYTRKDVRRHLVVHTGCKDFLCQFCAQRFGRKDHLTRHTKKTHSQELMKESLQTGDLLSTFHTISPSFQLKAAALPPFPLGASAQNGLASSLPAEVHSLTLSPPEQAAQPMQPLPESLASLHPSVSPGSPPPPLPNHKYNTTSTSYSPLASLPLKADTKGFCNISLFEDLPLQEPQSPQKLNPGFDLAKGNAGKVNLPKELPADAVNLTIPASLDLSPLLGFWQLPPPATQNTFGNSTLALGPGESLPHRLSCLGQQQQEPPLAMGTVSLGQLPLPPIPHVFSAGTGSAILPHFHHAFR

SEQ ID NO: 64280 - protein, 252 aa, Homo sapiens
  Payload ID: 12823
  Gene Symbol: PLAGL1
  Gene Name: pleiomorphic adenoma gene-like 1
  ENSP ID: ENSP00000376124
MKESLQTGDLLSTFHTISPSFQLKAAALPPFPLGASAQNGLASSLPAEVHSLTLSPPEQAAQPMQPLPESLASLHPSVSPGSPPPPLPNHKYNTTSTSYSPLASLPLKADTKGFCNISLFEDLPLQEPQSPQKLNPGFDLAKGNAGKVNLPKELPADAVNLTIPASLDLSPLLGFWQLPPPATQNTFGNSTLALGPGESLPHRLSCLGQQQQEPPLAMGTVSLGQLPLPPIPHVFSAGTGSAILPHFHHAFR

SEQ ID NO: 64281 - protein, 411 aa, Homo sapiens; identical to SEQ ID NO: 64279
  Payload ID: 12823
  Gene Symbol: PLAGL1
  Gene Name: pleiomorphic adenoma gene-like 1
  Uniprot ID: Q9UM63
  ENSP ID: ENSP00000392418

SEQ ID NO: 64282 - protein, 411 aa, Homo sapiens; identical to SEQ ID NO: 64279
  Payload ID: 12823
  Gene Symbol: PLAGL1
  Gene Name: pleiomorphic adenoma gene-like 1
  Uniprot ID: Q9UM63
  ENSP ID: ENSP00000395960

SEQ ID NO: 64283 - protein, 463 aa, Homo sapiens; identical to SEQ ID NO: 64276
  Payload ID: 12823
  Gene Symbol: PLAGL1
  Gene Name: pleiomorphic adenoma gene-like 1
  Uniprot ID: Q9UM63
  ENSP ID: ENSP00000400060

SEQ ID NO: 64284 - protein, 463 aa, Homo sapiens; identical to SEQ ID NO: 64276
  Payload ID: 12823
  Gene Symbol: PLAGL1
  Gene Name: pleiomorphic adenoma gene-like 1
  Uniprot ID: Q9UM63
  ENSP ID: ENSP00000400929

SEQ ID NO: 64285 - protein, 73 aa, Homo sapiens
  Payload ID: 12823
  Gene Symbol: PLAGL1
  Gene Name: pleiomorphic adenoma gene-like 1
  ENSP ID: ENSP00000485907
MATHSPQKSHQCAHCEKTFNRKDHLKNHLQTHDPNKMAFGCEECGKKYNTMLGYKRHLALHAASSGDLTCGVC

SEQ ID NO: 64286 - protein, 463 aa, Homo sapiens; identical to SEQ ID NO: 64276
  Payload ID: 12823
  Gene Symbol: PLAGL1
  Gene Name: pleiomorphic adenoma gene-like 1
  Uniprot ID: Q9UM63
  ENSP ID: ENSP00000486355

SEQ ID NO: 64287 - protein, 102 aa, Homo sapiens
  Payload ID: 12823
  Gene Symbol: PLAGL1
  Gene Name: pleiomorphic adenoma gene-like 1
  ENSP ID: ENSP00000486632
MATHSPQKSHQCAHCEKTFNRKDHLKNHLQTHDPNKMAFGCEECGKKYNTMLGYKRHLALHAASSGDLTCGVCALELGSTEVLLDHLKAHAEEKPPSGTKEK

SEQ ID NO: 64288 - protein, 12 aa, Homo sapiens
  Payload ID: 12823
  Gene Symbol: PLAGL1
  Gene Name: pleiomorphic adenoma gene-like 1
  ENSP ID: ENSP00000486711
MATHSPQKSHQC

SEQ ID NO: 64289 - protein, 74 aa, Homo sapiens
  Payload ID: 12823
  Gene Symbol: PLAGL1
  Gene Name: pleiomorphic adenoma gene-like 1
  ENSP ID: ENSP00000486752
MATHSPQKSHQCAHCEKTFNRKDHLKNHLQTHDPNKMAFGCEECGKKYNTMLGYKRHLALHAASSGDLTCGVCA

SEQ ID NO: 64290 - protein, 64 aa, Homo sapiens
  Payload ID: 12823
  Gene Symbol: PLAGL1
  Gene Name: pleiomorphic adenoma gene-like 1
  ENSP ID: ENSP00000486763
MATFPCQLCGKTFLTLEKFTIHNYSHSRERPYKCVQPDCGKAFVSRYKLMRHMATHSPQKSHQC

SEQ ID NO: 64291 - protein, 80 aa, Homo sapiens
  Payload ID: 12823
  Gene Symbol: PLAGL1
  Gene Name: pleiomorphic adenoma gene-like 1
  ENSP ID: ENSP00000487447
MATHSPQKSHQCAHCEKTFNRKDHLKNHLQTHDPNKMAFGCEECGKKYNTMLGYKRHLALHAASSGDLTCGVCALELGST

SEQ ID NO: 64292 - protein, 496 aa, Homo sapiens
  Payload ID: 12824
  Gene Symbol: PLAGL2
  Gene Name: pleiomorphic adenoma gene-like 2
  Uniprot ID: Q9UPG8
  ENSP ID: ENSP00000246229
MTTFFTSVPPWIQDAKQEEEVGWKLVPRPRGREAESQVKCQCEISGTPFSNGEKLRPHSLPQPEQRPYSCPQLHCGKAFASKYKLYRHMATHSAQKPHQCMYCDKMFHRKDHLRNHLQTHDPNKEALHCSECGKNYNTKLGYRRHLAMHAASSGDLSCKVCLQTFESTQALLEHLKAHSRRVAGGAKEKKHPCDHCDRRFYTRKDVRRHLVVHTGRKDFLCQYCAQRFGRKDHLTRHVKKSHSQELLKIKTEPVDMLGLLSCSSTVSVKEELSPVLCMASRDVMGTKAFPGMLPMGMYGAHIPTMPSTGVPHSLVHNTLPMGMSYPLESSPISSPAQLPPKYQLGSTSYLPDKLPKVEVDSFLAELPGSLSLSSAEPQPASPQPAAAAALLDEALLAKSPANLSEALCAANVDFSHLLGFLPLNLPPCNPPGATGGLVMGYSQAEAQPLLTTLQAQPQDSPGAGGPLNFGPLHSLPPVFTSGLSSTTLPRFHQAFQ

SEQ ID NO: 64293 - protein, 168 aa, Homo sapiens
  Payload ID: 12825
  Gene Symbol: PTN
  Gene Name: pleiotrophin
  Uniprot ID: P21246
  ENSP ID: ENSP00000341170
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNAECQKTVTISKPCGKLTKPKPQAESKKKKKEGKKQEKMLD

SEQ ID NO: 64294 - protein, 166 aa, Homo sapiens
  Payload ID: 12825
  Gene Symbol: PTN
  Gene Name: pleiotrophin
  ENSP ID: ENSP00000376798
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNAECQKTVTISKPCGKLTKPKPQEKGKWRHRSGESLRRW

SEQ ID NO: 64295 - protein, 505 aa, Homo sapiens
  Payload ID: 12826
  Gene Symbol: PLRG1
  Gene Name: pleiotropic regulator 1
  Uniprot ID: O43660
  ENSP ID: ENSP00000303191
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGVALTADTKIQRMPSESAAQSLAVALPLQTKADANRTAPSGSEYRHPGASDRPQPTAMNSIVMETGNTKNSALMAKKAPTMPKPQWHPPWKLYRVISGHLGWVRCIAVEPGNQWFVTGSADRTIKIWDLASGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRHYTFASGSPDNIKQWKFPDGSFIQNLSGHNAIINTLTVNSDGVLVSGADNGTMHLWDWRTGYNFQRVHAAVQPGSLDSESGIFACAFDQSESRLLTAEADKTIKVYREDDTATEETHPVSWKPEIIKRKRF

SEQ ID NO: 64296 - protein, 212 aa, Homo sapiens
  Payload ID: 12826
  Gene Symbol: PLRG1
  Gene Name: pleiotropic regulator 1
  ENSP ID: ENSP00000423454
MEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGVALTADTKIQRMPSESAAQSLAVALPLQTKADANRTAPSGSEYRHPGASDRPQPTAMNSIVMETGNTKNSALMAKKAPTMPKPQWHPPWKLYRVISGHLGWVRCIAVEP

SEQ ID NO: 64297 - protein, 514 aa, Homo sapiens
  Payload ID: 12826
  Gene Symbol: PLRG1
  Gene Name: pleiotropic regulator 1
  Uniprot ID: O43660
  ENSP ID: ENSP00000424417
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGVALTADTKIQRMPSESAAQSLAVALPLQTKADANRTAPSGSEYRHPGASDRPQPTAMNSIVMETGNTKNSALMAKKAPTMPKPQWHPPWKLYRVISGHLGWVRCIAVEPGNQWFVTGSADRTIKIWDLASGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRHYTFASGSPDNIKQWKFPDGSFIQNLSGHNAIINTLTVNSDGVLVSGADNGTMHLWDWRTGYNFQRVHAAVQPGSLDSESGIFACAFDQSESRLLTAEADKTIKVYREDDTATEETHPVSWKPEIIKRKRF

SEQ ID NO: 64298 - protein, 131 aa, Homo sapiens
  Payload ID: 12826
  Gene Symbol: PLRG1
  Gene Name: pleiotropic regulator 1
  ENSP ID: ENSP00000424616
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGLMQIVLPLVEVNTDILGLLTVHSLQR

SEQ ID NO: 64299 - protein, 58 aa, Homo sapiens
  Payload ID: 12826
  Gene Symbol: PLRG1
  Gene Name: pleiotropic regulator 1
  ENSP ID: ENSP00000425147
MVESTLIETNIIFHLDWCISSPLVGFLASILFYKLFCLKRGTETFCTHPCVQVVEEDP

SEQ ID NO: 64300 - protein, 156 aa, Homo sapiens
  Payload ID: 12826
  Gene Symbol: PLRG1
  Gene Name: pleiotropic regulator 1
  ENSP ID: ENSP00000425914
  MOD_RES (1)..(1): Any amino acid
XIWDLASGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRQ

SEQ ID NO: 64301 - protein, 106 aa, Homo sapiens
  Payload ID: 12826
  Gene Symbol: PLRG1
  Gene Name: pleiotropic regulator 1
  ENSP ID: ENSP00000426497
DLVAGKTRVTLTNHKKSVRAVVLHPRHYTFASGSPDNIKQWKFPDGSFIQNLSGHNAIINTLTVNSDGVLVSGDRRNSSSQLETRNYQEKEILMNVEFFLSLFFSF

SEQ ID NO: 64302 - protein, 1896 aa, Homo sapiens
  Payload ID: 12827
  Gene Symbol: PLXNA1
  Gene Name: plexin A1
  Uniprot ID: Q9UIW2
  ENSP ID: ENSP00000377061
MPLPPRSLQVLLLLLLLLLLLPGMWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPAIVGIGGGGGLLLLVIVAVLIAYKRKSRDADRTLKRLQLQMDNLESRVALECKEAFAELQTDIHELTNDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLYCAIKQQMEKGPIDAITGEARYSLSEDKLIRQQIDYKTLTLNCVNPENENAPEVPVKGLDCDTVTQAKEKLLDAAYKGVPYSQRPKAADMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQIHDADVRHTWKSNCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYITKYKDEILAALEKDEQARRQRLRSKLEQVVDTMALSS

SEQ ID NO: 64303 - protein, 1894 aa, Homo sapiens
  Payload ID: 12828
  Gene Symbol: PLXNA2
  Gene Name: plexin A2
  Uniprot ID: O75051
  ENSP ID: ENSP00000356000
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKERLQSCYQGEGNLELNWLLGKDVQCTKAPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLPAIVSIAAGGSLLLIIVIIVLIAYKRKSRENDLTLKRLQMQMDNLESRVALECKEAFAELQTDINELTSDLDRSGIPYLDYRTYAMRVLFPGIEDHPVLRELEVQGNGQQHVEKALKLFAQLINNKVFLLTFIRTLELQRSFSMRDRGNVASLIMTGLQGRLEYATDVLKQLLSDLIDKNLENKNHPKLLLRRTESVAEKMLTNWFAFLLHKFLKECAGEPLFMLYCAIKQQMEKGPIDAITGEARYSLSEDKLIRQQIEYKTLILNCVNPDNENSPEIPVKVLNCDTITQVKEKILDAVYKNVPYSQRPRAVDMDLEWRQGRIARVVLQDEDITTKIEGDWKRLNTLMHYQVSDRSVVALVPKQTSSYNIPASASISRTSISRYDSSFRYTGSPDSLRSRAPMITPDLESGVKVWHLVKNHDHGDQKEGDRGSKMVSEIYLTRLLATKGTLQKFVDDLFETLFSTVHRGSALPLAIKYMFDFLDEQADRHSIHDTDVRHTWKSNCLPLRFWVNVIKNPQFVFDIHKGSITDACLSVVAQTFMDSCSTSEHRLGKDSPSNKLLYAKDIPSYKSWVERYYADIAKLPAISDQDMNAYLAEQSRLHAVEFNMLSALNEIYSYVSKYSEELIGALEQDEQARRQRLAYKVEQLINAMSIES

SEQ ID NO: 64304 - protein, 1871 aa, Homo sapiens
  Payload ID: 12829
  Gene Symbol: PLXNA3
  Gene Name: plexin A3
  Uniprot ID: P51805
  ENSP ID: ENSP00000358696
MPSVCLLLLLFLAVGGALGNRPFRAFVVTDTTLTHLAVHRVTGEVFVGAVNRVFKLAPNLTELRAHVTGPVEDNARCYPPPSMRVCAHRLAPVDNINKLLLIDYAARRLVACGSIWQGICQFLRLDDLFKLGEPHHRKEHYLSGAQEPDSMAGVIVEQGQGPSKLFVGTAVDGKSEYFPTLSSRKLISDEDSADMFSLVYQDEFVSSQIKIPSDTLSLYPAFDIYYIYGFVSASFVYFLTLQLDTQQTLLDTAGEKFFTSKIVRMCAGDSEFYSYVEFPIGCSWRGVEYRLVQSAHLAKPGLLLAQALGVPADEDVLFTIFSQGQKNRASPPRQTILCLFTLSNINAHIRRRIQSCYRGEGTLALPWLLNKELPCINTPMQINGNFCGLVLNQPLGGLHVIEGLPLLADSTDGMASVAAYTYRQHSVVFIGTRSGSLKKVRVDGFQDAHLYETVPVVDGSPILRDLLFSPDHRHIYLLSEKQVSQLPVETCEQYQSCAACLGSGDPHCGWCVLRHRCCREGACLGASAPHGFAEELSKCVQVRVRPNNVSVTSPGVQLTVTLHNVPDLSAGVSCAFEAAAENEAVLLPSGELLCPSPSLQELRALTRGHGATRTVRLQLLSKETGVRFAGADFVFYNCSVLQSCMSCVGSPYPCHWCKYRHTCTSRPHECSFQEGRVHSPEGCPEILPSGDLLIPVGVMQPLTLRAKNLPQPQSGQKNYECVVRVQGRQQRVPAVRFNSSSVQCQNASYSYEGDEHGDTELDFSVVWDGDFPIDKPPSFRALLYKCWAQRPSCGLCLKADPRFNCGWCISEHRCQLRTHCPAPKTNWMHLSQKGTRCSHPRITQIHPLVGPKEGGTRVTIVGENLGLLSREVGLRVAGVRCNSIPAEYISAERIVCEMEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNTCQVINDTAMLCKAPGIFLGRPQPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPAMMGLAAGGGLLLLAITAVLVAYKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 64305 - protein, 1894 aa, Homo sapiens
  Payload ID: 12830
  Gene Symbol: PLXNA4
  Gene Name: plexin A4
  Uniprot ID: Q9HCM2
  ENSP ID: ENSP00000323194
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKIRVDGPRGNALQYETVQVVDPGPVLRDMAFSKDHEQLYIMSERQLTRVPVESCGQYQSCGECLGSGDPHCGWCVLHNTCTRKERCERSKEPRRFASEMKQCVRLTVHPNNISVSQYNVLLVLETYNVPELSAGVNCTFEDLSEMDGLVVGNQIQCYSPAAKEVPRIITENGDHHVVQLQLKSKETGMTFASTSFVFYNCSVHNSCLSCVESPYRCHWCKYRHVCTHDPKTCSFQEGRVKLPEDCPQLLRVDKILVPVEVIKPITLKAKNLPQPQSGQRGYECILNIQGSEQRVPALRFNSSSVQCQNTSYSYEGMEINNLPVELTVVWNGHFNIDNPAQNKVHLYKCGAMRESCGLCLKADPDFACGWCQGPGQCTLRQHCPAQESQWLELSGAKSKCTNPRITEIIPVTGPREGGTKVTIRGENLGLEFRDIASHVKVAGVECSPLVDGYIPAEQIVCEMGEAKPSQHAGFVEICVAVCRPEFMARSSQLYYFMTLTLSDLKPSRGPMSGGTQVTITGTNLNAGSNVVVMFGKQPCLFHRRSPSYIVCNTTSSDEVLEMKVSVQVDRAKIHQDLVFQYVEDPTIVRIEPEWSIVSGNTPIAVWGTHLDLIQNPQIRAKHGGKEHINICEVLNATEMTCQAPALALGPDHQSDLTERPEEFGFILDNVQSLLILNKTNFTYYPNPVFEAFGPSGILELKPGTPIILKGKNLIPPVAGGNVKLNYTVLVGEKPCTVTVSDVQLLCESPNLIGRHKVMARVGGMEYSPGMVYIAPDSPLSLPAIVSIAVAGGLLIIFIVAVLIAYKRKSRESDLTLKRLQMQMDNLESRVALECKEAFAELQTDIHELTSDLDGAGIPFLDYRTYTMRVLFPGIEDHPVLRDLEVPGYRQERVEKGLKLFAQLINNKVFLLSFIRTLESQRSFSMRDRGNVASLIMTVLQSKLEYATDVLKQLLADLIDKNLESKNHPKLLLRRTESVAEKMLTNWFTFLLYKFLKECAGEPLFSLFCAIKQQMEKGPIDAITGEARYSLSEDKLIRQQIDYKTLVLSCVSPDNANSPEVPVKILNCDTITQVKEKILDAIFKNVPCSHRPKAADMDLEWRQGSGARMILQDEDITTKIENDWKRLNTLAHYQVPDGSVVALVSKQVTAYNAVNNSTVSRTSASKYENMIRYTGSPDSLRSRTPMITPDLESGVKMWHLVKNHEHGDQKEGDRGSKMVSEIYLTRLLATKGTLQKFVDDLFETIFSTAHRGSALPLAIKYMFDFLDEQADKHGIHDPHVRHTWKSNCLPLRFWVNMIKNPQFVFDIHKNSITDACLSVVAQTFMDSCSTSEHRLGKDSPSNKLLYAKDIPSYKNWVERYYSDIGKMPAISDQDMNAYLAEQSRMHMNEFNTMSALSEIFSYVGKYSEEILGPLDHDDQCGKQKLAYKLEQVITLMSLDS

SEQ ID NO: 64306 - protein, 1894 aa, Homo sapiens; identical to SEQ ID NO: 64305
  Payload ID: 12830
  Gene Symbol: PLXNA4
  Gene Name: plexin A4
  Uniprot ID: Q9HCM2
  ENSP ID: ENSP00000352882
